United States Patent 9,567,581 (SELECTIVE REACTIVATION OF GENES ON THE INACTIVE X CHROMOSOME) - sequence listing, part 37

SEQ ID NO: 4458 - DNA, 1036241 bp, human
acactagcaatggcaaagctttgtgcggaggcattgctggctgctctgaactaaaagcatccgtggggaccgaaagaggtttttgcacaccttattaaggtaggcaagtgtgtctgagtgtgtgtgtgcctaaaagctggaagacatctgttgagaggaaagtgctcttctgtgggtctggcagcttttctgtaagtcttctattctgatgcaggagcgtgtgagcagtgggtgggaggagatgctttggtacttggaatgctgaggtccggattaagtggtattgtaatagctagttagaggcagaataaaaagctgggaatcaaagcatttaaaaatgcatccttccattatttgctctcaagttaaaccatattcattctaggggaaattaaaaaaaaaaaaaaaacacagcaagggcaagtagcccaaatctgtaaggtctttgagcttctctgttcgtccagcttttgaagtcttcctacagccaatttgtttggctcctctggagggggcaattcatatccacttccctctcctggagcatttctttcttctatactccatcagggaacaatagagtttaacagtaacaggcaattttttttttttttcaaagcttgtgccctcttctgcgtttaaaggtgttttttaagagactcctgctaggggaatcttggcgcctgtgtgttaagacggcaattaacttttagtatcagtgcttacattaaattttctctctttctgctttactaaagcagtcattaaaattcagtgtgagtaccatgaaactttatcataaaaccctgctttgcttagagaaccttgattgttttctgaaagcagccttctcagtttatatatacatagctgccttccttggaatatcaaattgctttgtgtcacattaagaaacactaggttgaacctctatactgtgttttatctgagaaaaatactactgcaaaaagtttgatttgttcaagttttaggatgaaaatttctttgtaacaagttatttgagttgcatactatgtcatcgtatatctctttagttcaagtaattttgcaattaacatacggttatgtaaagaagataatgatttattttttatttatatttttaaaagttattaagtgaggttttcctttcagtaagagtttagaaaaaatagccagaacaagtaactggacttggaagataaagatacctttgcacttctaaattttacctttgtacacttcggttgtgatttaatcattgaaatgcctctgctttgaagtaaatgcatcacttatggtgtatgctgtgttttaataaagggaaaacagttatgggttctctgttgcacatttgaatgttgttattttttgctgtatttaataacctcttttttctcttgtgaggtttactttggaaatgaggcatgttcaaaaataggctgacattcagcttctatgttttaaatttaaatgctgtctgtgttttatcacatctggaatgtgtggggagaaaagataccaagttttattatttagatttaattgtagaattgcagattgatatttttcaatgcattttcattatagtttctgccatggaggcagcgtgagggctttcaggaagatggagtggtgtaattaccaggtgcgcacgttcattaatccttcctggctagagaaagcttcaagttcttctccagtggcccattcgtaaagctataaatatctaaattgtgtcagccaagaagtcacacagaatggtggctctttttgagttcaatttcatgcactgttgctttggtcttgtgaggaaagctctgaattccttaggatagtcttggttgtgaagttccaaaaacaaaatatcaaatcattaaggatttaatttaaaatacatactcttctttcacaaactagatgattgcagtaatgtggattataaatttttttttttgctttatttctttagagctcctctttttattttgtatgatcaagattatagctgagattttggtgatttttttaaaaagatttatggcttatggtccatcagtctctccactacttcaaacctgtgtacccctgtatattatctgcagtactggaatgtttgcattgtatgtggaagctatatacgatttggtaaaaaataacacttaaaggtcttcgctaagagtgcttatttaatcattaaatatcccttaataaaaataattccagagatattgtctgtgtacaaacttaaaaaaagagaaatataaaatactgtgatgtgaataaaatgtatagcaatacactccaataataccattcttatgttttcccttgttctcaactgaaataactaagctaatagagacgtcagtaaggaatgtgttgtttcttcataatacaactacaaactcatctgataagaacaacctgagagtgaacgttaactttcctcattagaaagattcaatttaacacatatatacaaatacatttttaagataatgatatttgcagagtttttgtattctatggagtaaaggagaattatcacatattcaaagtaaaggtataaaatacatcttaatgttttacttaaattttaaagggtccaaaatatactaaaattgtttttctaattctttcctatgtttaaacgtgccagagtcattggaaataggacattctttttcttaagaagattttgcccaaaatatttaaaactattttcttttcccttgattttacaatttcaatattcatggatttttctactttaaaaataacagtagtttttatgatcttaaaacaaatgtttaagggcactttcgctctctggagactataccatccacatatttattatcagcaaaagaaagggcagggcatacttttatttgaagttgagtataaaaatgtgtctgtgtgtgagtgttattaaaaagataagtgaagagacaaatatagaatccaggaacattttcagcctggcttttactctctctaaaaatctaatgaaacccttgagcatctcttatctcaaggtacattaggaactgtccaacactatgatccgatgggagatcagtatattcatataaagaagaaaatttgttgttagtgaaagtcaagtcttttaaaaaaataatagttacagcatttgcaatatacaagcataatagatttactcaacgcccaccccccatctttaaaaaatcaatttccgacagttgtctactttaaaattgaacatatttgctacctggagggaacattgtaatgtagcccatatgtggtatgcatcctgaagaaaacctgaaattatagaggaagttatcctgccttctttcttctgttgaatgagttaaaatatattaacaatttgcctttcactttgtatttatcattttgtatctttgcatatttacatatacattcatgtgtacaagggcatatatactcacaggtcagggctatttaaacagctatttatttgaatatgccagggaaaatctccaagatataaagaagcagttattagatactatgtcagtatagaattaacagccatcttttttaagatggaagagaaaattaattaattacatacaatttctaacctcaagacattttctttctggagacaaggaatactgaggtgctcacgatagtgaagactcaacaagaccctaataaaatagatgaggataagtaaaactacaatagccaataaaaaacaaaaaacaataaaccatgtttcgctggcatgttggtgagtatctctgtaatatctgtcaataagggtctctgtagatttggagtaatgttcaggaactacctgtactagagaagacagtggagaggactccagtggctaaattctgctgcctttgcttccagaaatgtaaataataaggaggtattgtggcatttcctggaagcagtagtcttgtttcatggtctgactgtataagaatgcctagagaaacataacctcagctgactaaactcccttgatgattgtcactttgtcactgaactctgaccataccttttgcctccagaggcaaaagacgggtgaggaagtgatctcctcatctggtttttaaacaagtatataactagagaactggattatctcctaaacccactcttgtccctggaaaaaggggagtcatcctatccgtttcttagccaatttatgtatactcttagtttgagagcatgagaaggaaaactattttcttttcttaccttggctgggtttttaagaatttatttttagtttaatcaaaataatattttaaaaggtagtaagcctctcataagcagtttgatctgttctaaaataacttcaatttttctttttttaaactttcttttatcttacacacaaagtataatagtaatatgtactcactagaacaaatgaaacaggatggagtcacatagagaaatatatcatattctccctatcccctcccttaatattaacatttaggtgtcatgtgcttctccattaattttcattgcaaaggcctaaattttcttccaagagtgaggagtagcagcacggtagtttggacctgatatagctctctttccctagccttttgcttaagtgctttcctaggggctgactttacttacctaaagatgtttcaagcaagggctcacatttttggtagcagaagacacttactgattgctctcactaataattttgaaaggaatgtcaaaatctgggaggatcatgaaagaaatatcagaaatttcctttcagctgccattctccttaatactgttatcaataaattcagcatctcatatgtgatagcaaaaaaggtgctgccttttgttcttgcatcctgaggttcttacctaataccatggtagcaataaagatggtgagaaaattgcttcttctatggtgttcaggtcctgaacgagcaccctcacctccacagacggtggcaggtattcaagcattttacagactttggagttaaatatagcagtgttattctaatttaggtatgccaccaccagcggcaccggcaactgcaataggaaaaatgattggcaatgccagctatctgatgttttcatgtgccaggtgctgtcagttcttcacagtattacattccatcctcacaacaagagagtgccagtgagtgttgctgtgtgccagtgcccaggctaagggctttgaacacattaccctgttttatcctcataactttccacgttatttttattcctgaatgaagaaacaagttctctgtagagatgctgtcattgatccactcatatcctttcacatccgtttaacattttccctgctgtgcttttactcccaacaactagctccctaatcgctctgttggagggtggccttgaggctgccagagcctatttggtctgtgtaaagagagagatggatctatcctggaatttatgtccctgtgtgtgggaagcccttaatcaatgactgctggttgcagacacataaatacgtgagctttcttgttcccaactgagaaattcagaagtgtgaatggcactgccaccctgggcttttatgccatatatgtgtttggtctgtttcccttcccaatctcacttcattttcccttaccagtgtttcttgaaaacacatcccattagatcatttttgcatgaagcttcatctcagaacctccatttagggaacccaaactaagatattctctaaaatagaaactttattgataaagtttccaaactgtcttagtagatggccaatataagaccaagccaaatctttctgggtccaaattccctgtctttaattaatagactccattacaacacattcttcaatctttagtcagcaaacacttaccacgtgcctattttatggcatattatatttataccatagttaggatattatggttcatgaatattttatatctgtacacctgaaattctattgacctctctgggccacagttttgcatctgtaaaatcagcacaataatgctacttatctcatagagtagacttaaaaacgaatgaaatgatatatgccaagtgttgagaatcacaattggcaattactcatgctcattaaatattagctgtttttatgagtattgtttcattttcggtgcataatatcctatgcaaagaacaaaaggtattggtataggcattgaaacttgaagcatagaagaaaaagttaattaaccggtgccccactagatgcctctaactgctggctccgtgtatccctttagccttggctcgtcacgagaaaaccttggagacatttctgctggactcagcagatcaatttaagaaagatgaatgacatttttcttgaaatgtattcagtcatagctgcctttttctactttcatattttggagttcttagaaaaaattaaggactcctttttttaaagaaaatggtataaaagaaaatgcatatcactttgtcactttattattgtaacctcatcaaagtattcagtgtaaagacagtagccaagtgaactcttcttgtaatgctcggaaaccattttagcaatggtaaaattgctgcaatttatattcgtcaaattgcatgatttgacttattttagaaaagttattaacttctgaagagaatgcttcagaagcatttaaatgagtacaagttatcaccagtgatatacataaatttcatttcaaaatatacttctagaaactgtacttagttagctatagtatttgtacaaggattaattcctatttcattttgtaggaatttatttatgaatgtctatggcctgccagtgtaaagcagacttagagcatcatcttttacaataatctttttttttttaatcaaaggggagatattctggtaaaacaaaacaaaacaaaaacaatagtttattctgcatttttattaagtccctctgtaagtcatccctgaaatgggatatgtagagtcttatatttatttatttctcagaagcttattggaggtgatatgaaggattttaagaccctactaactaacaaaacaacaatttaaaattaattttcaaaataccttaacaaatcttattctccttattttcaaattctttaacaatgtttttcttattactaacataatatcttctgatgtagtcataataatatctaaaatgacaggtctaagtaacttacatggattaattgagtcttctaaatagtaaggtagatggcactattacttctatatgagaaatgaggaagtagaggtataaataagaaattttttggccgggtgcggtggctcacgcctgtaatcccagcactttgggaggccgaggcgggctgatcacgaggtcaggagatcgagaccatcctggcgaacacggtgaaaccccgtctctactaaaaatataaaaaattagcctggcgtggtagtgggtgcctgtagtcccagctactcgggaggctgaggcaggagaatggcgtgaacccgggaggtggaggttgcagtgagccgagatcgcgccactgcactccagcctgggtgacagagcgagactccatctcaaaaaaaaaaaaaaaaaagaagaaatttttttgagtgtatacagttagaaaatggcaaaatgggaattcagacccaaacagtaagactcaaggatacctttcttatcagtatgctaatatgaaaacctaagcatactagaaaatctaagtgccagttggaaaccagaattaacattttggtgtgtaactttctggctgctttttctatgctaacaaacatatatgacatacaaaaatacacacatacacaaattcctgttcactacttcttttatgttaacatcacaatgtaccgtacacagctgtattattttatatttgatttcatattttttctaaagtcagtgtatttgtcaaatatcaacttatctatttaataggaatatgggatgatctttgcttatacatacatacatatgtatataaaaacaaaatcaagtattttaagcgttcaccagaagtcatatgtcaatcagtaaagtatataattttttgctgccaatgacatatatcataaaaacgctacctatcatagaatgaaaatgaaacacagcaatattgggacacctattctcaagcaacagctttgtgatttattagctatctcacatgaaataactcattaacttggtattccaagcagcaaaagaaggatcacttaggtcacttgcaaaataatacaaagctaggtttaggggtgggttgcgcttggtgggatgtagatgaaaccatatgggcccttgagtttataattgctgggatctgcatggtgggtatatggatgtttattacagtatgctagtgagttaagaaagaagaggaattattattgacttacatcatagagtttatgcaaaaattaaacgataatttatttttaaactctagaggtataggtaccatcatgaagggacccacagaactgatgtagccagtaattattggagctggaacagatactctgctgtcagttgttctggttttgtggtcattgttcttgcctttgcaagttaccaactctaagaccttgggcaatactttaagtcttggttgtctcatctgtaaaatggggagagcagtaagtgtcttaaaggtttattctcatgttatatgacttacggtatgtaaaacatctgcgtttagacacatagagggtgcttaatggatgattgctctcattattaggctacatctaatctatgaatttaaaaactgtatagaaatatgtgacagattctttaagagccaaataccaactacagtgaaaaatacttaacacttgctgagctcttagtatgtgtcaggcttaactaccttaatgctcatagcaatcctataagataggtactcttgttatcctattttatatcttctaaaattgaagcaagggaagttaaataataggacaaagatcatacgctatctatccatatatacccatctggctgtctacctgtctccttccatccatccatccacttattcatctacccatccatccactcagttacttctctctctcccaccatccctttccctttccctctccctctccctgtctctgtcactctcctttacttatctatctatcgatggatcggtttatctatcatctatctatctctatcatctatgtatagttgttaataacactaacattttataaattacaagactgaaaaatgttttcattaacttatggtaacaaaagaccacattgtgaataaaaaaagcagtaaacacaggtctctgcacatatgaaagagatgtcctaaacaggaagagatgtcctaaacagtagggatacatagtatcatacaatcaaaacatggcagccctataaaacttacaaagcaatttcatgtaagttatttcatttgactcttaccacaatctatgaggttactatttttatttttctcattttacaggttaaatttaatatggcttccaataaaaaattagtatggttaataaatatcttgacgtcttgctcctataatcctaccgatagtttacagtaattagtaaaataaaataataggaaaaatacctttgatactagtattaaattataatcatatcattaggtaatttcaatttgtgattttcaagaatctgtaatatggtagcttcttcctactgacatgtttgaattcattttaaggcttataattcacaagtaatctatatattatctaaaatgtaaatgcacattcacatggagataataaattagcgtgaaatggctgtattttgctctctataatttttaacatacaggaaatcactgttgtctcaaaaatcaaggaaatatagtatttgaggtgaacttattctttctactattaacacattttaatatagttctctcacagtgcaacagagcaagaagctttcagacacatttgctgctgcaaggagcatgctgtgctgaacttaaaacaccttccctttcaaactccttgggactgtttttttccaagagacttcaaatgcactaaatttagcatccgttggaggcacacccaggcatattatagtgaaagccccaataactgaatgtgttaccactattcacaatgtttatgtgtgtatatgccttatctatgatgtattgcaaattacaaaaattgtgttattattcacagtaacaaaaacacttccagcaaatttctaacagtgatctcttttgaaataacttacatacatgtgtcatgggtcttaaactttgtcacttttatgtttccatcatgttgttttagccagtgagggttttgtttggttttcatttatgattatatactttcaaaaaatagatttcaaagtgtgaatttgattgattgattgactgattcattgagacggtgtttcactcttgttgcccaggctggggtgcaatggtgcgatctcggctcaccacaacctctaccacccaggttcaagcgattctcctgcctcagcctccctagtagctgggattacagatgtgcaccaccacgcctggctaattttttgtatttttagtagagacaggggttcaccatgttggccaggctggtctcgaactcctgacctcaggtgatccaccctcctcagcttcccaaagcactggaattccagacgtgagccaccgcgcccagcccgtgaattttatttttgaaagacaagaatgtccttgcctaattgcataatagtttaacatcatgaagactaaatatgctttttagccatgacaattttatttattattgttttcatttttaattttctcaaagatcctcatcagtgtactctttttggtcttccttataagcgtattttaacaggacataataataagataaatcccaactttttaaagttgtatccgtatgtattactttaaagtgctattaatataaacgaattagaggcaacttttattcaatcagattttaagtaattttaccaaaaatatggccttgataatgtctctgtaacaggttctctgtaatatacatgctgaggattggtttgtctttgcttttgatactattttaattagaaaagtaatggggaatccagacccttctcatttaataatccagagaaaaatcagtccatgttctaatagtttaaatttttctactaaaacccatgtgagaatccatatgagtggaatggagaggagttcagcttcaaagttggcagatttgagatgattctatggcaacagaaatgtgcttgagggaaatcagttgcggcatcttctataattgtgtcacctagattttgccttaggaatttctagatttccatagaacattgtgacctcaaatgctttatcttaataaagaaataaaagcagattagaagaattatttgcctacagtttgtgggagatgggcaagtcttaagagtttattaggtacccagaacgaaacatattttcttgggcctcataatcacattgaaatacaaggatttagttatacacagtgaccagttagtgaatgacagtcttcagtatctagtagacagtaaacatataaagatgtatttgtggccgggcacggtggctcacgcctgtaatcccagcactttgggaggccgaggcgggcggatcacgaggtcaggagaccgagaccatcctggctaacacggtgaaacctcgtctctactaaaaaatacaaaaaaaaaaaaattagccatgcgtggtggcgggcgcctgtggtcccagctactcgggaggttaaggcaggagaatggcgtgaacccgggaggcggagcttgcagtgagcagaggtcaggccactgcactccagcctgggcgacagagggagactccatctcaaaaagaaaaaaaaaaaaaatgtatttttacttttaactacagcgagagaccctggcagcctacagcatacaattagtgttcattatttagattgcatggatttaatgtgaggggtcaattacttgtctaaccagtgagcctagcctcttgctcaatactgcctgcttcatgagggtgaactgtgctggagaaatatattacaggattatctgcagattttttttaaatgagtggttaagtcaaaagttcttgtgaaaattcagagtaataaattattatgaagttgtgtaactaggtaaaggatagtttcttttacacgggtaaagattaacatgaggaggaaaactttagcaatggcatttaattccattcaatatatttatattgagctcctttaaaaatacagggccttgtggtgggtgctgaggacagaacaaaaaccaagtaatacatgaacataacccttgatttcatgatctagtagacctataaaagttgtcgatatctgatgaaaagaaaatggtaaagatattccaaacagtgtatgcaaatccagagataggatggaggggctctacctgaaggatgatgataagaaaaccgtgttgagtgaagggtgatttgtggaattcagataaaatatcagtcttgaatgctgagtgaatactcaatgattgactagatcccatggacagtaatttcttcaattatgacgatgctagtgtttatgactataactatcattctccatgccaggcactttgccatttggtaaatgtatagtgtgctattctaacaagcatgcacagagcttttactttaatgtatccatgagtttattggggttcagaatttaggtaagctttgcaaggtcgtagcatggagtaaaatatctgaaattcagacccatatctaactaagttcaaagactgtacagatatttctcctcctttgtgcagagaaggataggaatggttccatattatcatggacttagtcagatgttttaaaattataatgtcctgtgttaatgaagaagggatgatattcagtgcatattcttaaccgttactttgcttaatgctctcgacttttctgtgagatggatagtgtagataaaatccccaaggggactcagcaagtgcaagtaaaacaatgaaactttaaagccctttgtcaaaacctctctttttctcagaggatggaagggccgtaaaggttggtgaggaaggatggaccatttcctatgtagtcttctgacaatattcaaacaaaaggagagtcagcaaatcccccttgatgtgggaagttttaatacaatttgcagagtgtctctctggagtagacatcctcctctgcaatcgtgtcttctatatagcctcagggctttgggtaggtaatcctctccaaggagagtcctggagagggctgtctaccccccttgcaccatcctctaacattattctatagctcagctccttgtttctgtttcctgccttgtttttgtctgagtctgcaattatgatgtaagcaccatgaaggaaggtatgttgccagtgtttgcatcagcatatcccccgtgtgtagcagcgcaagggatatagtgagccctcaatgtctatttgtagaaaaaagaatgaacgtatcaacgaaatctgatacatattcattgtgtctgttatctccatctctcttgtcctgccttgttatcttgccattttcacaaaaggccccaaggcccatcatttcttgtgtaacttccagagtgttaatttttaaattaaaattaaggctttctacatgagtgtctattatttgagaaaccatgcaagatcgtgtgtgtgtgtgtgtgtgtgtgtgtgtgtgtgtgtgtgtgtgtgttgcactctatattatattgaattctggattttttcttataaataaaattttaaaaatagttctttaaaaataggaataagatgttttaggaggcacagagagcaaaggagaataaaaattgcaggtttggggttgtgcatactaattgccattgagtaaagagagcacactgaggccatttagaagagaattaacgtgttttgtttttgtttttgtttttgtttttgtttttgtttttgttttgagacggagtctcgctctgtcacccaggctgaagtgcagtggtatgatctcggctcactgcaacctccacctcccgggttcaagtgattcttgtgcctcggcctcccaagcagctgggattagaggcgcccacaaccacgccaggctatttgttttttttttttgtatttttagtagagacggggtttcaccatgttggccaggctggtctcgaactcctagcctcaagtcatccacccgactcagcctcccaaagtgttgggattataggtgtgatccactgcacctgaccttatttttattcatttaaaaatattaaatgttactgcatagggagtaatgggcttaacaatgaggtgaccaaaactcctatgtaccatgcagagcaatgtatcaaatgtttttaactataaacttctcaaaaacataaacctaattgttctgcagctgcaggttatatctgccttgtttgagcaaaatttggtggtgaaaatgccttgcttccatttttccttcaataactgatatggtttggctgtgtccccacccaaatctcatcttgaattctactcccataattcctacttgttgtgggagggatccagtgggaggtcatttgaatcatgggggcggtttcccccatactgttctcatggtactgaataagtctcacgagatctgttggttttatcaggggtttctgctcttgcgtctccacattttctcttctgcttccatgtaagaagtgcctttcacctcccaccatgattctgaggcctccccagtcatgtggaactataagttcaattaaactactttttcttcccagtctcaagtatgtctttatcacagcatgaaaacggactaatacaataacctatataattttgaaaagtacttgtctaatagactttcacaatagaaactatatccttatcaactttgaaaagtcattgcttaatgcctttggataactgaattttctaagattattttaattttgaaagttaaattttatcccagtgttgacgatttttgtatgctacttttaaaatattttgtcagtgatttatatctatggtgcaatcttgtaaaaaattaacaatgcaaatgtggctagaccatttaaaaatcaatatgttataattcagcccatttaatcactttagttaaacatcttaggaacaactcagttccatttgagagaagacacagttttctagatgtgtgttgtggcatcatattgctttacaatatcttacataaggtgaattcaaatcatatcattgaatctgttttaaattctgtcatagcttaagattagtgactaaatattggcaggtttatggaagtaggatgtaaacaagacaaaaacaagggtggaacaagtaattttagtatattattcacttgcacagagaaaagtcattcacaccttcttcagctttgtgaagaaaatagactaaaatcctgttgatatagcaactatgttttccgtttcttgtataaaaataaagaaaacttcctattaggaattagccagacattttaattttctctcttctttctctattttcccttacagtctctttgaaggcaggcaaaatttctataaagttttaagaatgttttaagatttttttattgtgaaatattcatagactcacaaggagttgcaaaaacagtacagagatttcctgtgtatacataacccaactttccccagttacatattaaccaaatacagtatattaccaaacccaataaactgacattggcacagtgcaatcaactagactgtagaccttacttggatttcacctgtttttgcacatgctcttttactgtgagtcattatctgttattctatgacattaaccatgtctatagatttatatagttactaccactatcaagataaagaagtgtttcatcaccacaaagtaacttaaaggattatttttataaagtaatgacaaatgtgtcaaaagccattcctgtgttatatagcaagtatgttttgagttattaaaactcactgatcatgtctttcagtgtcataactttgggtttccctccctaactataataatcctgatgaattacagttgatgaatatgagaatatccaactcttcctgactctataaatatattgactgagattgtaatatttatggtgtcttaaggggcgcttgttttattatgatgatgtgaacatgttgagaatagtaagaacagcccagtttagcaaacaggatatgagtcttctatatccagctcaatcgttgccccaacaggggacatctgcctttgctacttaattttccattctggaaaatgtgaagtgtatgagaatgaataatcgtctccgattttccagcacataataatctgaggagagcaggtacagcaatttaggagctgttttcttttggtttccaaaaaaagttccgtccagtggtctaagttagtcgtttactaagtgatagagcaattggctatgctttttgaacggactgataattatgtggatgcagcaaataggatatagacaatgcatctactccattacagtaaaaaagactctgatagcagttaatccacataccaggcacttagcttaggcacagttggaggaaatggaatggtaatagactgtagtatggcatgacaggagctgtagcttgagattcagaattccaactctgcctctcaatatttgagtcctcatggccaagatatgtaaagtgctctgtgcaggtcttggcaaccatccaccacacacttagtatgcaatatctatctttattagtcaaggatctggaaagctagttgatgagacaaatgatagaaacaagagttcattagatgaaataaagtaataaatgatgcaagaatttaaaaaagatttagagaaggaaagggaacagaactcacatgcaagtagagcaactgtgtatcagataatgtgctagctgagttagaaaccatgtctcatattaccctgaaaataattctgcaaagctgtaggtgttatttttttcatttgacaggtgaattcatgaaggcttgaatatagggttaagtgagttgtttcaatgtagttattgattcaaatcaagatctgaatgactctaaatatggtgctatagagatttgaagtaggataaataggatttgaaaaaaagaaaaaatatatagggaaaggaattggtacactgtagcagtgtcataaatgaagcttcagttgtgtgattccagatgatgtatgtgaggcctaatcaaacagctttgtggaatcaaaatttctgctcttgtctccaactggggacgagttggctcgggattaaggtgggcgaccttgggaagactagagtctaagcaggactttagtccctcataagaattatatgaggatgtatatttgcatacaaattcctgggcccaccgagatctgccaaattggaatgtgtggtgatatcacccagggaaacatagagagctgttataattagtcatgaaatatttagtactgaaattatagattatgttaaataatcacttataggggacatagcagggttggcaggttaaccatacagcaaacagggttgtaagtcagggcctagagaattttcaagaggcaggaattctgcagaatgaaggcctggtctcatgcagcaccatggacagctccgaggcactcttgtttctccaaaaacctgaaatcaaaaactttgcttttcatcatgcaacatacccatgtaacaatcctgcataggtactccctagtccaaaattaaagttgaaaaaaaaaactatactttcatttgaatacagttctcttcggctttaccagctctactctggaaggaatatcttttactcaatgaaaggccatcccctgttaatgcctggccaggttctccttatcagtcattcactatctttgtgtgtgagtgactaaacatataatgctatgtttagtggatggagtaagattacctttgcagaggttgtactggcttacccctttggttcttgtagttttcttctattagagttttttccatccctaggtttctatactgttcaaatgggtttaagattcttgaaggtattcctctgaccttgtaatttatgcttgtctcctagcacaacttttttttgtaaaggaggcaccaactatgtggtttgctggcgatggcatacacaaatcaggtgggaggaattaatgagagcagcaattccaatatctggttcttcaagattaacttgtatagtttaattcagcattctaaataagcctcatagatttaaaaatctagaataaacccacatttttaaaaaaagttttatgttatctgtgctgataatgcacgctgtacataataaaatattattttcttttttttaaatttattattatactttaagttttagggcacatgtgcacaatgtgcaggttagttacatatgtatacatgtgccatgctggtgcgctgcacccactaactcgtcatctagcttaaggtaaatctcccaatgctatccctcccccttccccccaccccacagcagtccccagagtgtgatattccccttcctgtgtccatgtgttctcattgttcaattcccaatattattttctaagtggcagtggaagaaacatggaaagttctacttcatccatcggtggattagaatttgtataccatgagatgattaattttcaaaaccagtttgaatctcacaaaataatgaccctgttttttgaaggacaaggcagaacaaggaactaggctgtgccacgttcaagtcacaatctctaacatttgttttgttttgttttgttttgttttgttttgttttgttttgtttaatctctgttgcttgttcactttctcttgtaatctgcattgatttgctacctggctatttgtagattgacttcggctgccaggaatggaatgtttttcataaaggaacatatgccttaatgaaagtaccataagaagggagtagagtgtgaccaattgcctaggtaataagtagtgacaacaatgatattattctagtataaatggaatcagtttttctttgcccagggggcatgataaagaaggcctggctggtatatactaggtgggacacaccaacagtgcctagaatgtcaatggatcaaacctgagggaaccagaagttgaaaagacatatcccaaaagaaagcatttgatgtttaagggttggcttacttagaacacaatgaaaaatattactaaaattaaaactatgattttagctatttttaaatatgacaaattaaatagcagaacattttaataaaacattacttaaggtccacaattttctgtaagtctaatacatgggtcattaaaataaaaaattccccatgatttatggaatcagatttttttaatacaacgaattctaaatggttttataatgccaattccaattaatatcctaattataacatgtcatccagaagggttaatgactaaattttattaatatttgttttctatttattttgatttgtgcagtttatgtgtatagtaacgatagctgcaaattagataccattagcattaaataaggtatatattttaatagaaaattaaagttaagtatttgagctagcctaaaatattcaacaacttaaatttgttttttgtggatcacatttttttgagacaaagtcttgctctgctgcccaggcttgagtgcagtggtgcattcatggctcactgcctcaaccatccaggctcaggtgatcctcccacctcagcctcccgggtagctgaggctactggcgcacgccaccatgcccagctaattttttgtatttttttttagagatggtgtttcaccatctggtctcaaactcctgagctcaagcaatctgcccaccttggcctcccaaaatgccgagattacaggcgtgatccagtgcactcacccctgtgaaccaccattaaatagctaataaaagatgcatgtcaataaaaataaacaacttactagaatgattatgtgaaaatcatttattcttccaaagcatgaattttcaaacacaccttttgttactgttttaagaagggaatcatttccatatatttgcatgtaaatcacttttagtctcagagaactttccataaaagtttttttattactgctgtaaccgatagagctagtggactattaatttaaaaagctgtacataaaaacacatctatagctcaaataatctaggataccttttagtttggggaaatgtagatgaaaatgaagtaattacagaatccttgttaattttcagatttagacagtctaggcaatatctttcaggaatgaagagatatgtgttttttggcatcttggtagagtatattcccattgtaattcttttgtgaagtctagaccagatgtggccataaaaatagacccctactacaataatatatttcatagataatccaataaagtcaaatcttattgcagtaggcttagaactctgtttgcacccatggaatttatatcagtttttggcaaatcctttcatctctgaggatactttttcatctcacatataccctattttctgaacattttgccttcaaagtatacctcatttatcaagaatttctctttattcatctgacttatacaagtggcaataacaacgtctggttcccatgaagtaaccagtgaccctttgaaataatatagcgctggaagaaagaaaaggaaagggagactgatcattcagcaactctttaaaaccatgtcaccgttaaacacatagtttattttatcttttttttagaattgtgaaaacctatattagcatcttcacggatgtctcctttgtttacatccccgcttctgtgccttgcctgcagtagaaaaaaaaaggacatgtgtatccctattccccattgtcttctcattctacatgagaatgagaattcttttaatttcttctctatctacatgaacccacttccattatctgtttgttcagttctttaaatgccctgaagctagctctgtgactgggcagttgaaagttctggacttagcatcaggttaatttgaaaaatacttattgagccaccaccatatgtcagccactactgtagatgttttgaatgtgtcagtgaacaaagcagaaaagatgtatgccctctggattcttgggggtctcaaatagtgaaagacagatacgataagtatattgtatagtatgttcaaaagtgataagtgctgtgaaaaaaaagaagaagggtaaaataagagatggctcatgctggagtacattccaattttaaatagggtatcatggtattcttcattgagaaggtgacatttgagcaaagatctcaaagaatgaggcatggggttgaatcatgtagatatcagcagtaaactcattttgggttcagtaaacagtcaatgcagaattcctaagccatcggtttatctgctgtttggggctggttatctgcagtgtggctagagtgaagtaagtgagagaggtttaggagagaatgttagtgaggtgagggtggacctttgaagccattgtaaggacgtttttctctttctaagtgtgagaagatgatgctgactgagaccagggtgataagaaatagtcatattctgaacgtgtttggaagtggggccaacaaggatttctggatgaattggataaggggcatgggagaaaaatggagtcatgaatggctccaacgtttttgctctgattaactggaagggataaagttgccctaaactgaaataataaagactatagatagaatggggcgattagggaggcattaaatttggatatctgttagacatatcaccagatatattgaataggcaattgaataaatacctttagagttcagcaaaaaaggtccaggttggacgtttaaatttcggaggtgtttgtataagataacatttaaagctgtgatatcagattgtatcactaaggaagaatatagatagaaatgacaacgtgactaaggactctaacattaagaggtggattgacaaaggagaaaacagcacaggataatgaaaaggaatgatcagccaggcatggtggctcacacctgtaatcctagtactttgggaggccgaggcgggcagatcacgaggtcaggagttggagaccagcctggccaacatggtgaaaccccatctctactaaaaatacaaaattagctgggtgtggtggcacacacctgtagtcccagctgctctggaggctgaggcagaagaattgcttgtacctaggagacagaggttgcagtgagccaaaagattgtgccactgcgctccaacctgggcgatggagcgagacttcatctaaaaaaaaaaaaaaaaaaaaaaaaaaaaaaaagaaaagaaaaggagtgatcaatgagatgggaagaaaaacaaaagtgtgtggtgtcctcaaaaactgacgttctattttcaaaacctacattttgggtctccttttactatatcctgactttctagctatataaccaaaaggagaaagcagtaatttttttagatataacatgttaataactctaagggtattcaatgaatctgaataattcagtggtataatgtgaaaaaatatagtattcataggaaaaggaacagaagttagctcaggaaatgacttgaatgaacaccgaagccaaatctccagcgcaggtccacgtattatttgtctcagtggttgaattagcagcaagattccttagtaggatgaaaaaagatgttgtgagcatctgtatctacatgactgaattaaattcctccaacaatgaaatgtagttaacgtagtatctcgaaaagaaccctaagtggaattcagggaacctaaattccaaccatggttttgctgctgactgattgcattcacttcaaatctatcattaacctccttgtgcctcattatcctcatttcaccaaataagaaaaatgaaatattcctccttccctacctcactaggatgttgtggatttaaatgtgtgagaagtgcttgagatgcataaaatttgatggagtgttttattcatgaattcaaggcatctgaagtaatttgaccatgatggacagttgcttccttgcacattttttagagtgacatttccgttactgacccacccatttatgcaacatgttgcctaatctaaatttaggtcaaaacaaattgaccttataggtaagcattatatctattaatattgtatttttgtattattttataatattcatcattcacctattttctcatgcaatatatgttactgaacacatatagattaaaaagccttcatccctaaataacaatgatgggaccttccatttttatatccctctggcatttaaaatgtgcttttatagccatcatctccattgatctctcagtcccttgaggttgatatgacagatatgctttttccattttaaaattacggaactgacagtctcagatgactttaccctccaactactgtgtgaagaagcagggtctggcactgaggtcttctgacatccagtgtagagcactatacttcacaatatggccattggcttactttattacaagcactaaatattttccactgaatacgtaatacctagaggagaatgtcgtgtaaaacagcagcagtagaacagaggattaaatgacccattttcttgaagttatcttagttttaaagggttttttcttcatcactaatgaccatccctgactaagaaattattctcataatacatgataatatctgcgttttccaatgcgacaagaatgttaggatgtctatacatgatcttgacaatccctagctccatcacaatgtgtccaaattcattttatttggctagacaggcatgtagtcttactttcaatggttggctctgctggatgctatgtgatctagaacctgtcacttaccccttctaaacttcaggaattttttatccttaagataacaagaaaactcgtacctgtttcaaagagctgtttgttcaatcacctatccattgattatcttctatatgccaaatgtttttctaggtgctgaattacaggaatgaatcagaagcaaaaagttcttactctcaaggatcttatatgctaatgaaatagatgttaaaaaataacaatttttgtttcattttattttattttattttgttgagacagagtctcactctgtcacccaggctggagtgcagtggcacagtctctgctcactgcaacctctgcctcccgggttcaaatgattctcctgcctcagcctaccgagtagctgggattacaggcatgcgccaccatgcctggctaatttttgtatttttagtagagatggggtttcaccatattggccaggctgttctcgagctcctgacctcaggtgatctgccctccacggcctcccaaagtgctgggattacgggcatgagccagcgcacctggcattaaaaagtaataacaatttttaaatatcaatatgtcttatacagaaaagtgagcagtgtggtagagtgtaactggaatgtgagttgagacataacaccagacagagaagccagagaaggacttttgtttgaggaaatgacatttgaaaaggaacctgaatagtgacagaggcagatacctaaagaatatgttccagacaaaggaaacaaaaagcgtgcaattgcatagtcaacttagcctacttgaggaaaagtgtgagtggattttggtgatggagaggtaagtgccaggagatgaagggagagatctggcatgcatcagatgatgtgcagtcttccgggacgttgtaaagagttgggctttttttgtttataaattaaatgttaagccattggggtttttaaccagaggagttatgtgatatgatctatagttaaattatgtttgttcttggatggagtgtgcattatgggaatttatacagaaacaagatttcacatatatatatatataaaactcagtgtcaatagaaaataataaaaacaaattttatccattgataattctggcattgatagtagtgggtatggtggtaataattgtgtgtaacactcaaactttctgaaaacctacacttgatctgtaaatccaaaagtatatgtagcaaaagccataatctgctcttatttctgcaccacttgcaccagtgtggagtgataaggcaaattattcaggcacctgtgtaagccttcagtgtcctcacccccttgttataactctccactaatattacattggtaaagacgtccctgacctatatgtcactgagacctcaaagaaaagagcaaagctaaagcgtaagggggaaaaaagccagcttaaaaagacttaaaggtttctgggaccaaaaaaaaaaaaaaaaagtctttgaaaaatgagaaaggaaggatagaagaaaagattctcctttggtcaatctggccaacctttggaaataaaaagtattgtgttgcagctaataactatttgtcactgcaggcacttgctgatgtctgccctttaaaatgacccaaactcgttggcctcgaaatcagaagccaaggaaaaaatcttggacataatgttttctgtagaattaccaattttctctctctctctctctctctctctctccctccctctctctctctctctccatatctatatatatatagatgtatatatattttttctgtaggaactaccaattcctatctatagggactgattgagaagtcccttatagcagtttttctttggcttttaggatgcaatgattattggtgagaataactctttcatttcacatttgtcattggcttatttgaatgtaatcctgattcaatcgttatgatctcctttaagtaggaagagaagctggtattacattgtaggattttaattttgtactcatgaaacttttgaaaaacattactcatactcttctgactgtcaaattggcctctaagaggtccacatctcaagaggtatcaagcattggtaactattttttggtgttgttttctcatcataaaatgtacttttattaggtgactttggaaattttattgaatcaatgcatgacactgcctcattctagtaatctgatgaagcaaagctgaaaaacaaaatttgaggattgtcagtatatatacttttatttgcagtcaagagttatgctgcaaaaatggtttattgaagtaacaaaattttagctgatatattaatctgaaagatacagtatacatttttagtatggaaaagatgaggaaaaggaggttctctttcctctaggtatctagagcaaactgtaactgtccttggtatttaatttttggctaaggtactgagattagaggtggggccttagatatgattaattgtcagactgataagctagatatttcattgagtttctgttgtgctctttctttcagatcctctgttcgatgctttgttataaagatttgggcatttcaaaatcttctccatatctggtgtctttccaaacagcaggtcatagactttacacaaagaggaacgacacaggttataagtagaagtgttttaaaccctgagttcctatttcagttttgctttcttaaacatattttccttatgtgataaatgcgagtgttgaatggtgataaataccacccataggctttaaagcctaaatgttgaatttgacactgagagtttaaaggcatcatgaaaatttctccagaactaatgttcaagcaatttaggttttacaggcaactcaatagttttgaatgatgtagttattttgaaaaagtcaccataaaacgctatgtttagggaattggtactttgcatttatcagaagattgtaaatgtcaatcgattggcttgctatttggaatataattttttaaattatagttcaaatcattaggatttaattcatgattttgtactacaaactaaatctatgaaaaatatcagatatttattttaaattagaggcatgtaaaggaaaatataaattttgaaatgccattttactggatttttctcttcagcccaccctaggcatttgttacataaaatatttctgaggaagtcttccactgattttgtaaacaaacatgttttattgaacagttctttgttgactagattaacattgaccattgtatgcaatgcattctcaaaatcttagaagctggttttctttttaatcatataattttacttgttttacagtgaaattaatgcatgtaaaaagtatacctatatagaaagttaaaagaatattgctaactagttactatacttccaaattgcctattttctgtgtcttgcattggacagtagtgattacctctaaaagaaaatggatggtctttgtttcattgaagggatggataatggacataactggcattcttgagcaatgcaattgcaaatacatgtctttgcatttatggtccaatcatcttcttactatgatagcatataattgaaggttcaaataaatgcctcgtcccttcctgtggcatattaaagagaaagaaaaattagaaatactttcaaagctacctcacatactaatggtagagttgtttgagtatttaggtgatttaacaaagctgatgtattttattatgcttgatcattgaggaaaatttatttatcggaatgcttttgagagcatatatattgtcagagataaacacagctggatattaaagaggtaaaaacagattttattcaatacctcgtgaaattaggggagagctgagatccattctaatttgtgcagaggcgacttggttgttttaaggcaagaaggagggagaaggagtgggggttcattcgagttagagaagtaaaaaagtacaaagggctggacagtgtaaatgtgattaggccagctgtgttagctggaagttattgaagttaggattctatcttcccacagagaacaggagacagaggacttatccttcttgatgatgtcatttgaaaagaatggctttcaggtccttgagtgagagacacttctgatttccaagagctacatgttcacaattgtaagcccttttgagtaaatgttctaagaaacggaggtaagagtcctatcaacagatgtgtgttggctagaacaaacattaaattttcctggcagcactgagctttctcaagcaggcacttaagggaaggctagggtcatcctagggacatggccttctggggctagaaaccatactagagtttagtcaagtcttagtgcaagggtttggacagagttgttaagtgctgagagttctgtatttctcactgtcacaaaggaagatcagaagctcctgatacttttttcatcagtacaattgaatatataaatcctatacacaaaaataaactaagcttatacaagcatattggtcaaggaatgttgctggccttattaattagatagcccagttaaaagaagaattttttaatataattaatgttaaagtaggatgatagtatataaaacgtgtctactgtcctgaatacaaactaaactgtttggtttagcatttacctcaagatctcttaatatcccccaaagggtccctaaaaccacaacttatctttgtgctcatgaagtagagaagagacagttaatagacatttctagctgatagactgttgtagagcagagaacgctctgtgtttttgaaaattaaacatatgaatttgcccctcttcccctattaaggaagaagagtttcttaattgtgcgaacacatcaagtgaactattcaattagatttttgtgacccagggtataaacatctggttaaggttacatatttcaaaggaacaaaacactagaaactcttggttttaaatctcatggctggaggataatttgcagcagagatttatctggcaagcatacagaattgctgagactgttctaaagatgtaagtgtgggtgtttgtgtcgtgaaaatagctgtttacatctattaagtggataccgatggttgaaagtgccgtctatgtcaagtttttaccaaatcaacttttgcctcactgtgtcagaccattttacctaatcaacttggactgctaatgtcctttcccctggcaccactatctgtctcttttgcaaagcacagaaacggcatgcatgattgtagtttataaaacacatgtaccaatgtggtctacagcttctgttgagttcgagagggtcagtttctgtaatctcttctggcacagagtcaagaacagcttcactttcctcctgctacctctctacccgtaagtgtgaacccatcactttgctaacactcaggaaggggattacacaaaatagagcaggagccctctgacctgaatatgcatctgagccctagccatagagcttctgattcagtagatctgggatggggcctaaatatttgcatttttaagtgtataagtgatgctgatgctgctggttccaggaccacattttaagaaatatcgataaaggtggagaattaaactgcagctcagaagacctgagttcttgccccagcttgacttttacaatctagcaaatggataaaactcgcaggacttcagttctcttcatctacacagtgagtggttagattggctttgtaatttaaaattaaacagggtttgattctgattcactacacaaggttccaaagaaggaatgatatctcctttcatttcttcactttgtcttctgtccctaggtaatcttatctatgttcctgatttaacctaactaatgtttctgcaaagcttctaatatttacatctccagccctgaaactctcatttgaatgctagtcttatatacatacccccctgcctaattgacatctccacttaaatgtatcagaggcaactcagactcaacaaggaccaaactgaatgttcgaccttgtccttcaaacccgatacacatccaggttcctccatcccagtgaatgacactatccagttaagcaagccaaaagtctggattttttttcctcactcttcctcactgtccgtcaactaccattattaaatctgtcacctggtcctactgatttaaccttctcaatatctctacagtttttctttatgcccattagtatcctagtgcaagctaccatcgtctctcattggaattaacacagtaacccccctacccaccagactgttctgcctacagatagtgtgatatttaataaatataaatctagccttggctagatttctccttcaaaaggttcacattaattttagccttaaaatggtgtgcaaagctttgcatagtctgtcctttgctatgttggcagtattttttactatccctctcatctgctcattctctgtactccaactacactaactttgtttttttttttttttagatttctctaactacagtgctgtaatctctttttcctttgcacgtactattccgtttgtcagggaatctgctcactgtctccacccactccacacactcacgttttcctgcccgtcttaccggtcttgatcggttgtcacttgctcaggaaggtttccctggtcaccccctccacaaattgaattaagtcctcttgctgcatgctgtcctagtgctctttattttcctctcctcatccttaattcagtttgtaattacatgttatttgtgtgaggatttgattattatctgtgtcacccactagatattgggcattctttacttactcaccactgaattcatagaaccacagtaattgtacacaacaaatattcaagagaaatttattgaattgatgaatgaaaagttgtaccttaacatgttcctgacatgtatccaaaaaagagctcccctttggggtctattaggactttggacctaggtaaacgtaaccctagtttcgctcaggtttaaacagtagaaagtaattgggtctcttttgcatgtggctttcctaagggctaaccctgtcttcggaatgagtcaatacagcagagctgttgaaagcagactctagcttcggacaacgttggtccgaatcatggttccgtcatttcttagctgtgtgatttagaataaattaatgttttaaagctttgatttcctcttccttaatctggagatgctaataaagccaacttcgtagaggtattgcgatgagtaaataagcataatttgctgtaaacaccttgcagattgcctgttgtatgctaactaatcaataaattgaagctcttaacatcattatattagatatttccagcattgagtatactatcaggcatgtggtagaagctcaatataaagttttgttaaattgaatagattccatatatggtatttctacagcattatgctccttatttaagtgtctctaagtattttttaagtatcacctcacaaaagacagatgtttaattcattacacatgtgaattgttttagatagaaaataaaataaaaaattcaaacattgaaatcaatagtgtaccttaccttaggattacaccataaaatttctaccaatcgagaataaagtgtacagtctatttcctttctaatacttttaacgcaacaaatgtttattgaacacttactacttctaatctatgacagacataaagatgaataaagcatgccacaatgtttaaaggagctcactatatcataagaaagcggattcacacagacaactctataagataaagtggtaaatttaggctggcctgtgaaacaaaggattataggtatagttaagaggtggaatttattttacttcgaggatttcagttacctttatattctttgtctaacctttcatgtttctctttcttcagaaacagagcacctttttcctgacacattcatttccccctatggagtagagcagttgttttcaaagtgtgggtcccagatcagcatcacggggatggttagaaatgcccattcttgagcctcacaacagacctactgaaacagaaattcttggagagtggagcccgcagatctgtgatcaagccctgtaggcaattctaacgcacactcaagttaaagaaccacgggaagaaaggtccatcctgtaacaagacagatttttttcattagcatcaattttgatcatttatatatatatatatatatatatatatatatatatatatatgcatgctcacaaaaccattcaccttactaggttttagtattccccttcctgtattcatgtggtatgtatgtatacaagatgaacacacatttacctgagacaaggtaagactacacatgtctcatttggggaccagaggctgtaatcttactcaaggtcaaagcgtcttcactgctttctttcactgcttttcaaaagtaaaatttccatgtaggtgtcatttgttttctttttgtgttttagaaaaccgattaaggggtgaagtctggctaaacttagtgtcaggacatttacttagataaaattattttaatttatcttgtaatgttcaatgtgagaagaaaagtccttatgagtagtgtattccttaaataacaacaatttaaaaactaccactgaagtctgtcagagtagttttgcctcatttgtctagataagagaaaaaaggttcacattagggattgcaatttgtctgccaaagtgcagtttatttattcagaaacatttagagaggaatgtgtcagttctgttgcaggcactgtgctgtgacggggagctcaagatgatctcaaaaaatttcacagatggggtgggcagggggcacagagagatgtatttagtggttcagatactatttagactgtggccagcatttctctaaatgcaatccagataacaccttacagaatcatctgggcagcttgataaaagctgtagactcctacccttcatcccaaacctattgaatcagtgtctgtgtgtgaagacctagattgtgactggtaattataccaaagtcttagaagcaactctaggccagtaatactcacatcagaatcagctggagggtttgctataccacagattgctaggttagccttcagagttgctggtccagtaactttggtgcaggtccagattttgcatttccagcaagttaccaggtgatactgatgctgctggccttgatcgtgctttgaaaaccactgctttagctacgctataggaaaaaccatataaggcttttatactggccaatgacttcacaggcctgaattttagaaagcccccttctgcagcttggcctatagattcgaaggaaacagaactaacacaagaaagctagttaggagctagttaaaaatcatcctgacttgccaaggaaaggtgctgaagacctgggtcacagagcaaatgcaaaacactaggactttgtccctagttcaccattaaatcaacttattttctcttaccccctcatattcacgtttactccttactttgtagtggttggacaaaaatcaaataaatctgagaattctaaaatgcacacccttgtttattttctaactcaaatatgccactgttgtctgtgctctgtcaagatttcaacacatctttttctcctgtttgcttttccttttggcatatagtgagtgtgtgtatacacacacacacacacacattttttttgactccttccaatgcccttctgctctccgcagatacacttctgcattctgaataaaaccgaatacatatatatatatatatatatatatatatatatatatatatatatgcacacatattttgaaaaccttatttgaaaagaaagctttcggaggaaacgttatttagccacttaatcgagtcttttactgagggactttttgtcgtcccctaacttcctgtcagcagtccacaggcagcaggaataatgtgggagaagatcaacaggcttatttcaggaggtcaggggccagtgccaccacctgcaggtggagacatcagaagcaggaagcagcccaccagctgcagggagaactccccacagagcctaaccaagatgaagggacttgtaaatttcaaccctcccttttggcttttgtgctaaaaatgtgaatattgaggtctgccctgattaagaactagatacattcctctttgtgactgccacacttccttagcgtattcattttttgtctttcgatctcaagttattattttcaaatgcattgcacgtatctaccatggataccattgcaattggaaggagcaaacgttttgtatgtttacttgacaaagagaagtgactgcccaagccacacagagttctgcacaaatcagtaacttctaacgaacgtttgcacttccgggcttgttctctacctatttcagtcgatgcatttgtattatttacttcaaactccaatactaataatgcctcaatcaggttgcaattgggatttgagcagccagaatttcagaaatttggtttggtccatatctgtgacaggtcagtaaatcagagaagcaagggtttggttgctattataatacattgcttacctatcaatttagttatcagccaaggtggttgttatcatccaaagtggctcattaaccaccttggagactcagtatacaattgcaagtaaccctggaagttgtaaataatcccaactgaatttgtatgagtttggtaaggttaagtggaaaccagctgcttagggccttgattataaatgaagttaggagtggaagaagtaacaaaaccccaggcaaattcattaaacattttttcccttcaactttatgctcacgaatgtgttgagactcttctgaatccataaaacacctttcagcatcatctgggcagcttgataaaggctgtagactgcctgcccttcatcccaaacctactgaatcagtgtctgtgtgtgaagacctagattctgactggtagttataccaaagtcttagaagcaactctaggccagtagtactcacgtcagaatcagctggagggtttgctataccacagattgctaggctagccttcaaagttgctggtccagtaactttggtgcaggtccagaatttgcatttctagcaagttaccaggtgatgctgatgctgctggccttgatcatgctgtgaaaaccactgctttagctaggctataagaaaccatataacatggacaaggcaaatgaaaaggttggaattcttctgaatcccaacacatttgtgagcataaagtcgaagggaaaatgattcttctgaatccagacacatttgtttaaggataaactgttttttccttctgaaaatttaatgtctgattctcgttcattcattcatcaaaagttatcaactatcaactataggtaggaactgtgcaatatgctggtgataaagagatgaaagacacagcccctcccttcaaccagctcctagttgaggtggcaagtcagctgtataatcaagtaattgcaagactgtgcactgaaaagggtgaccacagggtgtgatggccacccagggctgtggaatcagtcccaaaatgaagaatgaaagcagggaagggtaattcagaaagaagaaacagttcgcataaagacccatagataaacatcaatcagatgtggttaagacaaaagtaagtttctggaggctgaggaccttctcagctatatgtttgcagtgcttggtatagggctttatgcatctacatggaagacagaaagggccacatcacagtggacaaggcaaatgagaaggaggcagtatcagaagatgagggtacaccggagatcctagttatatatgggcattgtgttcatctcaggagttactgagtaatgggaccttgactcaaatgaatctcaagtctgtttttgcctaatcttggttttaggactaggattagcatacaaccgcactaggagcctagttatacgaaaggctgcattgcggacctgatacagttcaatatacatactgtcaccttgcaaatagggttacgttagttctcaagactgccaatcctctgtgctctaatccttttggcttttttttttttttttttaactgtctcactctgtcatccaggtgaagtgccctgggatgatctaagctcactgaaacctccgcgtcccaggttcaggtgattctcatgccacagcctcccaagtagctgggattacaggtgctctggcgccaccaggccctgctaagttttgcatttttagtagagacagggtttcaccatgttgcccagactgatctcaaacgcctgacctcaagtgatctgcccgctttcctttggcttttaacactatagagcaagggtccccagccctggggccacagaccagtacaggtcagtgacctgttaggaaccggggccccacatcaggaggtgagctgcagggccgccagcattaccacttgagctccaccttctatcagctcagcagcggtattagattctcataggatcacgaaccctattgtgaactgtccacacgagggatctaggttgtgtgctccttatgagaatctaatgcctgaagatctgaggtgcaacagttttatccccaaaccatcgcctcccacgcacctctccccacaaccccacccgcccctgatccatggaaaaattgtcttcctctaaaccagtctctggtgccgaaaaggttggggattgctgctatagggcgatggttttcacatttgatcctgcatcaaaatttccaggtgactcattaaaatactgattgctgtgccccactcgtaggagttctgataaggtagctgtggggtgagacctgagaatttacttttctaataagttcccaggtcatgctgatattgctttgataaccaaagcaatatcagctttggttatcaatatataaccaaagccacatagagggggagaagttccttgggtttagcccagtgtttactgcgaccaccaaaattgctggagcttaaccatggctcagagagttatgttctgttcactctgtaggctgctattccctgtcaccttttgaactatgatggaggggaagagctgccagctcaggagatttcacttttttctctgcataattgaaaatccagaaacacagggttttgggaaagctatagaacagatcatcagtgatcagtgtttaataaagtaaagcaataaactttactgtgtaaaataggatactttattatataaattttgtccccttcccccacctcacaggccaataaaataatatacttcttgtccctgggtgtaatgttattggaaacctttgaatgtaggagaggcatgggcttgtaagttgcagaaaactgctagcctaggattgagaatttcatggataatccaaaaatagatgattttacagttataagccttacgtgaacttgaggtaagaaaacacaatgcctttatagtcttctcagttgctccacatgccctctgagattctgttctgcccagcctctctggttgtcacatctctgggcattaacagaaagttcacatactctttgtctctgatgataatccttctaggtccatatagaagatccctatccaaaccatcccccaaacaaacctattggttaaatattttctccaccgaaggcactttcttagattctaagtgccctgtaggcaggcttcctctctgatttgggagagtacaaattgcgacaaggttaaatcatagcctgggaatttgacctaaaattcactcttctcccatatgcattcatgaaccttctgctggtttttaaaagaagctacttaatgtcagctcgaagaggttggaaggggttaaaaacatgagcatggcagtaagaagatttatgaaggatctgagaagattatgacttgatcagatggtattttgtcagctagccacatttgtgaagacttgaaaactagggaggcttgtccttctaagagggggcactgctgggacctggattctgtggaaccgtattagtagaataaacaataacctttgcttgtatcaaatgaacttctattctcatgtgtcttttgacatatttttattaatcatatcactgggacctccttgctgaaagatatctccgttccccattctgatgactcccaactaggagtgagatcaaatgaagatggcatggaccatttctccatgtgacagctctctgtggttgccttttaacacttctaatgccctttctcttaagaattcccatttgtcgtctggcactggtgctgtgatcaataaaaatgtaatggagtgaggcttagaaacatgaggaaatttactcaagctatccatttattgatgtgtccatttgtgttgtcagggaagaaaaactttttcactcccctcttaggttcattacttggggggctgcaaattaaactgacgacagatagattggcaatagaaaagacaaagtttattcagagaagtatgtgggagctcacagaaaacatagctcaatgaagttagaatttggggcttatgtactattttaacaagggttttgaaaagaagagtgttagaatttcaagccacaaagttggtgggaaatatgaaagaaactaatgaaaggtaatgtttgttttagtaaagtctgtttatgtaattttcttttcccagcgacaacttctcatctctggtgacaggagtcactctttacccctggtgcaagaaactttccttaaaggaggatttaaaacagttgaattatttcagaaatctttgcttttaggcagatagggggagtacagaaaaagccccttcccgtatctgttgatcctcaaatggctttagctcaaaacaatttttacatcacgatggcataatgtagatctcttcaatgtgttcatttattccacagatatttgtgaagtacatgatatatgccaggtacttgggatacaagaatacataagtatgtccctagtctcgtagaacttacactctagtagtgagctagagaataaatgatattatttattatatgcatacacatatgatttcagatagtgatccatattggaaataaagctggttaagggaatagaaaatgatattgaaggtggacttgtttagattgggtggattggcatggcttctctagggggcagtatttgagcagatatgagagcagatattctccaatttgggcaaaaacattccaggcagaggaaacaagggcaagggcactgagttcaaaagagacttgacctagccaacaaatagcaaggattccagtgtaagagaaggtggggaaggaaggaggtgcaagtataggcaagggcaagatcacacgggatcttgcaggccgtgataaaagaatttaactctttcataattttgacaggacatcattgaagaatttagaaaaatagagtggagatacctgatctgctttcttcaaagagttcattcatcattgctgagtagaggttagactgaaatggaagcaatagtgaatacagggagatagcacaggaagccacgttactagtccacatcagaggtggttcagactagggtggagtggtggggtcagttagagagctggtatttaggatacattttaaagacaaagctgacaggatttgctgtgatgaattagatgtaaagtatgagaataattgagaattatttctaagttctttgctggggaaaagtggaggaggaaaaagttagggtacaaggtgtgatgaaatcaagagtctctcttattatcagagtctcattagatatccaagtggaaatgctggaaagaaagttgggtagatcagtctgaagctgaagacagatactgtgactggaataataacgtaagagttggccggacacagtggctcactcctataatcccagcactttgggaggccaggataggagaattacttgagcccaggagtccaagaccagcctgggtaacacagcgagacctcgcctctacacacacacacgcgcgcaaaaattaatcgggtgtggtggcacatgcctgtagtcccagatactcaggaggccgaggctgaaggatcacttgagcctgggaagtcaaggctgcagtgagccgtgatcacaccgctgcactccagcctgggcaacagagtgagaccctgtctcaaaataaataaataaataatgtggcagtcataggcccttagatggtttttaaagacatgggactggatgaagtcttctaggaggagagtttgggaaaagagcccgagaattgactgcacctttcaaaacaggaggaagaaaaaaaatactcaaaggagacaaaagcaacttctgtgatttatagagaaaaccaggcaagtgggatgaagaaagtccttcatgatagaatcaaaaacagtgtcaaatgttgaaaatacaattagacaaacacaaaagaatagaccattgggttttgcaatatggagctcatacttgaccttgataaaagacattttcactggaagcatgcatcaaaaaactatttgtggtaggttaaaatgtagtaggaggtgaggatatacagacagtggctttcactgtgcagatactgctgctcatgcactaattaaaagacatttgttgagtatctactatgttgtatccattgctaaatagtaacagctgggtttagtcaggtagaacagcatcaaaatcattatagtatcccaagataggtacagtaaaatctgtgaaggaatcagagtagtctcttctccaacagagcgtaagacccagcttcacggagaaggtggtagattagctcatctgggaggctgagtagaagcttgtcattatagagggagaacatcagaagtgtggacaacagcttgaataaccttgaaaggacaaaagaggacggtctgccctggaaatattaagaagtctcacatgattagacacaagatattaggggaaaggcataaggtgaattgagtcaatgaggtcaaagagaagctagctggaggaacaggcgatcataaaatgagtaaaagtatatattcaaagattctttttagaagggctacacaggatggataaggggagagagagagttgaggcacagagacaaattggaaaggtgcaatcataaccagagacatgaaaaacccatagaaatctgatgtagattatgtggtccccaaggttgaacaattaagtacgctttcagttgttatgcccatgatattaacatattttataactgcaataagtgctgaagctaaagataaatacaaacaatgtaattcttattctgtgagaaaatgttgtagctggaagttaaacatgtttcttagctaaagaaaaatattgtgtgatctggattacttaatgttataatttagcaacaaaatgttgacattgagccttgcataatcaaaaaagtagtctattcaataaccacattctcagaaaaaaaacaagaaaatattagaaacaatgataaattatcgtagtaatttaattcagtattctattgttttatttggatttaggaaaggcagaaatgttgaaatattaatatatatccctgtaataatataatttgtgtctgagaggtaggaatgagggcatgaggtcaaagtttgataatgaacttcaaagctataactatgatcaggaaattaaaattggacaataaattcctagaatcgtcaggagttgcttgtgaaatcgagaaaggaaaggatatacacaaaaataaagaacagccaatgctctcaaaggagtctaacttttataatagtcttctgtgttagagctgaactcttctggtttagaaggacactctgttgcctggaaatagggcatggaaaaagtcatcagagtcatgtcatctttcattcttcccatgaacgaaatcgaggccctgaaaagtcacctgtgtttgctgtattttattgcaactaagatgtgcatttttaaattgatacataataattgtacatatttgtgggatacatgtgatattttgatgcatgcataccatgtgtaattatcaaataaggatatttctgtatccgtcacctcaaacatttaccattgctttgtgttgggaacatttcacgtattttattatagctattttgaaatacaaaatagattgtcattaactatagtcaccctactggatgcaccttgtttttaatatttctgaaaacagatacgtctcataggtgatggtgtcacagctgtgcattagttattattgcctgtgcaggtgcaaacgtaactattcatattgttgtcaattaattaaatagttacatttatttatatgcgtttattatactaataaacacaatattgagatagttgagctctagttttgactctgctgttaactagctgcgttactttaatttacttaactaatttggctttcaaattcctgataagtaaaattacaacatgagtttctcctgctataatagcctgagaaatcggtgaaacacatgaattcagatgttgatgctatttaatagcgggattccagatatctacttgccattatgggagggagagaggaggtggactggaggctgtgatttccctaggaggttgttaaaattggccaggtgaggaaagctgagacagaccataaatatgaagcatgatacctagccctcagtgttgaaagaaaatcaaatctcatctttgtggtctaaatatcagtatgatacaatcctctgtgtagacatatcctctgccctattgttttctttctaaaagctaaagcccaggtgtgatcacatccctccgttatttacaaatttctgatgatgatgattcttctaatatctacattccttaccattaccatgatgtccaaaacctattataatctattcgtctccaagtgccatgttgtggtcaccctatgcaccctctaaacccaccatatgaccttcccgctgctacttgaatacagttggccctctacctcgttgtgtctttgcattgcctatttaattgcctttccattctctaaatcactctttcgctggaccagcaacatcagcaccatctgggaattcattagaaatatagatcctcaggcctcatctcagacctgcttgatcagaaacattggagagtggagatgagcagcctgtatttttatcagccctctaggtaatttgatgcacactaaagtttgagaaccactggtctagagcattcttctttaactctcttctaaaaattattagaatgaattcgagggacgggatctccttgaaagccaagaacatttctttgtcatctttctgacttcagggcgtagtacactttttggcccataattaaagctcgataaatgcattctatgccaataaatcagctaatcaaatatattattcatgcccttgaggtatctgaaatttgtttgcagaatgtaatatataactatagagtaacaagagaataatttattgccatagataataaaacaatatcctctgtataataaatcctagcctctgctcaatgggcaaaaacgggactggggtttcagattttaaaaagattattggtaattaaatcacctggagaagcacttgctgcagagatgggacttgaagcatcataataaactgttgtttattatgattcggtcagagctgatggaatcacagggattgtgtgaggtatggaaagtggttgacattgaattccaggctgcacagttgggacttgatatgataaccaaaaagaaagaatgtctggggtggtagcaagctctaaatttagacaatctaggcttatcctaaggagaatatagatacagataactgaagtttgattaaagggaacctggtgtatcacaaatagtaaaaagctgtagttagtctatgcagctatcagctagccacataatacttttgggcaaatacattataaaccaaaagaatgacatggcttatctctgtaacaaagtggctcattgttctttattctactgttatccttaagaaaaaaattttagtaaatttgttatgctatactcaacttcaagaagggatagcgcttataaaaaaattgtttaaagaaacaggcctatttctctttgggagaagccacggagaaacgaaaagaatggaacgtgtgtttctgcccagatggcaataaaatgtagggtaaatttctgtcttttaaaactgtattttttccatccctctgtatatacacatatcctaggactgttataaaatgctgcatgcgtatgtgaaaatggaaccttattgggctgtttgatggacctttaaaatatatttgttggtttggggtacatactagctatgcaatataatccgcattatttcttatgtaaacaatggataaactgtttcacagtccagacatttatttggtcactgtttgtagaatgtctattttatttacttctgaatttgtattccagagatctgccttcaatgttggatacttccactgtaatattctaggagatgctcactttctttttcagcatctgacacagtaccatctgcctcctcttttcttgccacaagtaataacaattttataaaggaggatcacattacagaattataggtggtaaactttctaccaccagatttacccaagaacctgaaacacattttttcaaaaggaaatagaatgtccttcttgtgactacatcggaattttgcttgcagcattatgctttttttttccccctagtgtagctagccatgtggaactgaagccattagccagctcctcatcctataaatgctattacctgggaaaagaggcagaaaatatactctcttctccagttagagtctaaaggaagagaacaatatgggtagttgtgtttaccacaaattgatagaactcctttattttaaatgctaaaaccaaataacttgtttatatgacttcaacattgactatcacacactgttgcatgataacagagtgaaaactacctctattggatttaagtggggaatctatgtctcattctcattctttttttactgtggaaactagttgattccaggatcagccttagctccaacttgccacactttgagttttggtttttcacttgcattgtcacaggaaacttctataggataaatcgaggaagattttactctgcaacgtgttgcagaattaaacatttaaagtggcaaaaccttcgtgtgtaggttgtctccccagagaatgtaaaaatgaattgaaggcagcacctaataggtaaacgacagccaatcaaacaagaacaaatgaaatttgactggcaaaatcaaattgaaaatgtataacgctgaatctcagaatataggaggatgcatagaaactaagctgtactattataaaagtcatagccattgaaaaataatgactggttaatttggttttctttacctcatggatgtgaatggttagattttgatgttggtgttatttgacgtgtgtttgtcaagaagttgccttagtcggctcgcatttaggataaaaaaaatattttaagaaatgtttaagagattatgttggagacattagaaacaaaataattatgcagagggcaggactatcaaaatataatagaaaaattacaccgctcttttatgatttcctcctttttggcatttaacacaaaactttatgattacacacaccacgcactccagaaatgcttaaaggaagatgagaggaaaattcaatagaagtagcaggcatttctgtgaggacagcagaatgatcacttcatctctgtattttttttttttcaaatttctgtatctgtacaatgtcttttccagctctaatattctgtgatttggtaatttccgcactcagattttctttaatgaattttgtatgatattacctatttttataccagatattacctggctctaatttctttttcaccctaggaaataaaagtatcgggtgaatttcccattttcttatgttattgatacaggtctctgttggatatccccacgattaactttcctgcagcatgttcgatggtggcttaaagaagaaaccatgtatcagagccccttgtctatatagacttttagataaagagaaatacatatcacagaattattctgggcgcatagagtctctaaatgcaaaaaaaaaattgtattgtagctgttgattcttctcagatagattgagtgtagagagagagcattccaaaaactgagcagaagaaacacagtctgaatcaaataacatgaaattttagctaacaagtaaataacacttttttcagaatatgcaaataatattggtttattatgaaaaatgtataggctgatagatgagcatagagaaaaaattataaatatcttctttaatatcactttccccagcaaaccacttttaacattttgatacattttcatgttcaaacatttcctaatagtcttttttcctgttatataaatatgaattttaaacattcgtatgtttatgaaaaggcaataagatactgctcttttataacaggctttctgaacttcacaacatgcagtgtattctaacatgctccttgtgttcttaactaataaaaaacctcacgttatttaaaaaaccatcttaaacataattatccattaagagaagaggttggggtagagagtttcagactatcaatatcaaagttatattttctgtaagtattttaatttttaagtgtagctataggtatatgattataaaaccaatagcagagaaaagataccacctttgaatatagttttccttggttccatgaaaatggcctcctttctttttgccagtccctcagtatcattaactcatttttctgtaaatgccatcattgtatcacatgtcctcaggaaaaggcacttttctcttttaagctagtgtttgttcttgttctaattttatggcaatttaacgagtaacaatcctgtttctataaatactgtttcctaattaatctattgcattctatccatgagaatttagatgactttctttgtaagagaaatctctgtagcatgagattcttctttgctcttaaatttcattctttcacatttttaaatgacctgatagtattttgttgtatttgtgctgattttttttaaccaatcttaccttgttgaacatgtaagttgtttctaatatttgcaatgatcaaaatgtggatccaacttcactaaagcgttaagaatctaaaacaaaacaaagaacaaaaagttggctgtcatcttgcttggaccaccccgtgagttactattttcttgtttccggtcacagttcatcctaaatcatttcagtacacaaaatgttttttaaagtttgggacagggggtagagaatgtcaattattcctccaaggcagtcatatgagcattgagtatcatgtggaatagttgttacttgtaaagttatggggcatcaaacccagtcaatatgtttctggaattgaaaaagtccctggacattctaatgatactgttgttcactttgcacctactgttaccactactttgatctgtcaacactgcccgtaatggttaattttgtgcatcaacttgactgggctacaaggtgcccagatatttggtcaaacattattctgggtgattctgtgcaagtgttatcagatgagattaacatttaaattggtagactgagtaaagtagattgcccttcctaatgtgagcagacttcatgtaattaattaaaggcctgaatagaagaaaaacactgaccctcccctgagcaaaagggaatcgttctgcccgactgccttcaaactgggacatgggctttttcctgccttcagactttaaccacaatattagctgttcttgtatctcaagtctgctctacttcgattggaactacactatcagctctctcgggtctccagcttgcttgttcaccctgtataccttgggagttgtcagtctccatagttgcctccataattgcatgagccaatttcttaccacatacaaacacacacagagacacacacacacacacacacacacacacacacacatataattatatatgtgtgtgtatacatattctcttattccttttgtttctctaaggaaccctaatatactccttattactctttctactgccttagagatcttcaaggccaagagcgtaatcctccatcctggctctttttcctaatcattaatgatcaactcatagccatttagctcaactaaaaataatttgttcatgaagctttacactcccacatactgaggaacgtggtacctaagatcaaacagtcactgcctcatcaaatgcattcctcttcaaccccatacaaatgtccccagatggaactcacaccataaaaatattagatcccattgacttttctgctttctcaaggatcattgcagagcttgaaaaagatggctcctccctttgcctaagcaggttaacttggtgtaaaagtacatgtaagatttggcacaaaggaaaataaatcagttttgcctgggtcctaagaaacatttccctctgcctcatggtaattgtacctgccagttgattgcattactcaagtggagaccatgaagtgaagtggtagaacaagaagaaatccctataattttattaagtatggtgaaaaatacagatatgtagagaaatgactgggattagatggagcaaaacataattcgagatcctgatacaaattgtacttcctggctcaagggagggagcagaacattccctgctacatgggaataataataaatgcctgataaaaatgcagatatatcatagactacagaagctgaagtggattcttatggtcccctactcagacagcctctccttcagatgaagaaactgaagcacagaaagctcatcctagtgtttcatattgaaaaacccattcaagtctattttaataacctgttaccaaaaatgagggaaataatttaactttaatgtttcactttgcattacccttttcctgactagacttctatccttttcttgagttgagctcattaactactatgaaattatggttatgggtagaggttaattttatacctgtccatcttctggcatcttatttacactaaaaatcatttttaaatggcttcattttaaaaaatattatttcagttgacattttaaaagacacatcatttatgtactacagaatatgcattttatactctcctttattaattttattattttccaggtagaccaatcaaatgaatcagaaattcttggttagatctattagacagcataagtatgtttttcatcattaaattaagatgaaaacacaattttactttaaagtgtttgacgtttccagcctttataaagtcaacacttaatcacatctgaaatttgcaggaaaaaattttgaaagccttcaattattaacattatttcgggagaaaaagccactttgccgcagaactttcacttttctctcgtgaattaagtctgatacaaattattcattatggtgaagtttaaacataatagagtctagctacttccacaaaaatactattcaatgagtttctacattgacatctaactgaccttgtaattaatgttgtacacgatccttttattatatgctggattatcaaatatgacttattagcagtataaagacacaaagttctgaaatgtaatttatagccatgaaaaggaactgagctttgtgtgacagttaaatttgaagagatcaggtgattattatgaagcatgaataataatgcatattaaactcacgtttttgtttaaatcattaatatgattgttttagaagaaagtctacctctatcatatgggcaataaaatgtgtataagagcaaacatttgtgtatgtgaaataactcaaattaaaaccagttttccacattaattcttacagtttttaaaatttaaatcatttaatgtatcacacatagctttattcattttaagctataaatgttacaatttctgtttaagctgttaatataagctttgtaagagcaattctgtataaatatagaattgtcattattcactaatagctaccatttatttagtgcttgttgagtgcaaaagtactgcactgagatctttgcatatgttctcttaatgttacaattcttacctgaggcatttctgtttctgctggaatatggtctctctgaattgaacaagggaggcatttttggttgttatgatgaaaggtggacactgctggcactaacgtgtgttggtaagcgactagactcttcatgatgcgtaaacagtgtttcctcatacccctgcacattcaaatagaggaaaaccttgtttatagttaatttcccctagaatgtaaatccatttaacatataaacacaaagcgtgttttgtgtggatgttttttactggagcagggagacaggagaggaaatgcagttttgatagttgctgaatttttcaagaatgcagcaattatagaacaatttctagaagtttcctaggagctcttttccatagcagaaaactaggacttaatagccttgcgactcatggtacttgagtgttccatacaactcacctatattcaggggacatttgaaaaattctacattaaaggggattcttaacataggcgcaagtgtctggcatcttcaataggtcttctggtgtggccatgaaaacattcacacgtttcaaagtattttaaaataaaataaaacatatattgttgtgttatgaattattttctttcttttttatatgatggttagatcactgtgcagacaagtttatgagatctattcatttcatttcagggtggtaaatgagggtgttactaaatgttggttctaaaaagggagacattgggtattacagaattcagaacagctctaagccctgtgcacatttagcattagaggacacaggcaaatctggcctccagtcctggcagcttcttcactatgtatatgatgttgggtgggttgctttacctctctagtttttacttttatttctaagctagggctattcatagttctttatcatgtggttactgtgaagtagcaaagcacctgacataattagagcagataaaatgctcaacaaatattgcttatcagaaggattatgtattacctcccgaaatacatcaaaaatatattttccaattcaaagaatatgtagtacaaaaatcatgcctaaattaacagagttgcagtagcccaaggagagaagataatcattattgatttcttcttcctttttgctaagcagttctctgtctctgcctcctcagttgttgtccatcccactcccccactcccaagccctgaactctgaggggtttgctgccgtggccggttctgtagtcattgctgtccaatgatgaaaacacaaaatactgcaacagaacactatgcctgtcagcttagctcccttctttctgctaaatgacactcaatcctattcttttgttctaaaggatatcctaaatgaatagccactggggggaaaaaaggttatataagattgtgcactgtgtgaaactgatgcaaccagatcaatgatgtgaatttctcttaactatttactgggatctagaaacaggtctctcaacttagcagtgtttacgaatataataggccttccttatacatacatctgaagccaatctgagtcaggaagagtcgtggtctgataaatattttgaaaacttgcatttgttctattaaagcaaactgtttattaatagtgtgccttattttttaaagcaaaacatttataaacagtagtcattacaggcacttcagtgtacggagtgatcaattgttagacctttaggaatcgattgtttcgtggagcttcggcttataattgaaatgtcatcagaaggagtgtaagacatagcttcaggagaggccatttatgcgcttttgttttcagctaagttatagagtcatcatgtgaagaaagattcttctcttagtaaaaatcctttaatggttggaataacacttgatatttaatatttctttctactttatatccacatttattcaagtgctaacgcgtgtggggcagcaatgaagcactttattccaacattatagttctcatatctgcgtatgattatttttcatttatcgttagcatatatataatgatgacttttaaagtacactgtattatattcactggaataatgattagctattaataatttgaacactatccaggaaattactgaacatgtcctacaagataaacctcgtatgatattgtctccaaataacagtgctaaccaagaagagtgctaccaagttcaaaagtaatcacagggagtaacctaaatgcagctccgttgggttaaaaatagtttctctaaattatatgttccctaagtttgagatcgatttctacaaggggataaaatgtttttataaattctcagtgataagtcatgtgattaagaacccccaactttttttccaaagacatttgcatctctgatcaaaataacaagatccagtcttagttataaattggggaattttcatcaaaataaggagctactcgttgcataagaagactagtacaacttaaagccaatttaatttcaatgaatgcatgatcagctccattgccaattgagtgtttttcttattcatcagaagatgggttcatcatcgtgtttcatatcaactgttctcaaaccatattgcccatttaaataaatatagatttgtctcgaaattctaaattcatgtcatatttcataaatagcctatggtcctatttattactttaaaatattatagatataatatttttattctaaagtaactgtgttatacaaccaaattattcatttaaatatgtgactttttaaataagtaaatgacttatttaagtaaagtcattaaaattttccagtctgtccttcatccacctgatctttgaatgagttaggaacaatacaggaaactaatacaaacttaattttgattacaaaagatgaaatcattctgttatttattcaacacactatgtgtcaataaaatcttatactgtgaaagaattcgtctaagtccatttgctgttgcttgtaacagaatacctgaaaatgggtaatttacaaagaaaaggagtttacttcttacagttacggaggctgagaagtccaaggttgaggggccacatctggtcagagccttctcccatccaagtactaaccaggtcgaacctcacttagcttccaagatcagataagagtgggcgcgtttaggctggtgtggctgtagacttgttagagcctttttgctcatggggacacagcagagccctgaggcagtgcaggacattacatggcaagaaggctgagtattctaatgtgttcatgtctctcttcctgttcttataaaatcatgaatcctactcccatgataacccattaacctattaatttatgaatggatgaatccattcataagggcagagccctcatgatgcaatcacctcttaaaggcacaatctcccggtgctgccacgttggggattaagtttccaacacatgaaatttgggggacacatttaaactatagcaaaattgtaataaaatgttatatagaagcaatgttcttactgattataattgttatattggtaaagtgttaagtcctctaaccaagggatatatttcagcttattataatagttttaaatttacaattcaatatgaataacatctggtaaaagttcttttcaagaaatgggaaaattagaaatgtttagaagaaaataattcaataaatattaagttcaaactggattcatagtttatgtgaaattctgggaaccaattgcaaggggagaaaatagttacaatagcaatggtgaggatgagaataagagcaggtatcaacgttaattgagggtgtgttatagttctaatcgtgctatgcccactacatgacttttccctgtgtgaggtttccgagcttcttcgtagtaatcctaaattgagctggagagaggctagggtaacttactcacgctcatagagccatagagtagtaaaacctgtatttgaactctggcctgtctgacatcattctgtggtcttttaaaccaccactgcttctccatattaaaactccaaatctaggtgaaaagaagaaaactcagaacatgttctgcaacaaaatataacaaaatataatgtatataaacacttatacataatatcactaatatctttactatgaaaagactctgatacgaacattttacataattcatgcagaagtgttaatcacattgtctgtgatgagctgtgtatgtatctgataaaattctggcaaccagacatcaactcgtaggcatagatctgtaacactaaatatttgcctcgagaaacttaaagaaataaagacaaatgaatgaataggaacatggaactgagtacaagataaaatcctcctaaagcaatcgatgtacttgctgctgcgttattgttctaagcaaaagaagcatggcgaagggagatgtgaagctaaaaacagaatgcttagaaggagatgatagcaggagggaagcaaagatgggaccaagctcccaaaaggcgggctttgaacaaacaaaacagaaagctaagcctttgacggatgcacgggatgcaagaaactttagtcaggaaagaggaggcgaagaaaaaccctccaaagaaaaggtgaacaatattttaataggcaaattgacagatagcaagagatatataccatgctatgttttctcattgcagctgaagacaaactggggttatttatgctttgaaaaagcgtaaatctaaaaaacaattgtggaggaagaagcgatgaaaacacgtgttaatacagaaaacatggctccaaggctttaaacttccttgtgagataaatgcatttacattttccgtagtagctaatatatatatatatacatatatatatatatatctgggaaaataatacacagtgattttctttctttttttcatctacttatgtgagaaaaaagtaggctatctgaaagcttttcagttaaatgaggaagaaagttaggtgatcttgtaaataatatatatgttcaagataatgtaaggcccttgtgtagttttcaaaacttatctttaatagcagtttcttctggggatggggtagttcaaagttgaaatgttagaaagatgttaactttttttcctttttacttctccctttcaggatggaattaacaaatttgattacaaatagatctcagagagaggcaaatgcattgaatccagaagtaacataaaattagatcatgtttagttatgcccgaggtcacatggtgataaaaatgaggataaactgaaattgtctgtgagccagattagtttattttatgccagtcctaggaaaaagacacatcatggtaggatacatcctttttttttttaattatactttaagttttagggtacatgtgcacagtgtgcaagttagttacatatgtatacctgtgccatgttggagtgctgcacccattaactcttcatttaacattaggtatatctcctaatgctgtccctcccccctccccccaccccacaacagttcccagggtgtgatgttccccttcctgtgtccatgtgttctcattgttccattcccacctaagagtgagaacatgcgctgtttggttttttgtccttgcgatagtttactgagaatgatgtattccagtttcatccatgtccctacaaaggacatgaactcatcattttttctggctgcatagtattccatggtgtatatgtgccacattttcttaatccagtctatcattgttggacatttgggttggttccaagtctttgctattgtgaatagagccgcaataaacatatgtgtgcacgtgtctttatagcagcatgatttatagtcctttgggtatatacccagtaatgggatggctgggtcaaatggtatttctagttctaggcccctgaggaatcgccacactgccttccacaatgaacagacacttctcaaaagaagacatttatgcagccaaaaaacacatgaaaaaatgctcaccatcactggccatcagagacatgcaaatcaaaaccacaatgagataccatctcacaccagttagaatggcaatcattaaaaagtcaggaaacaacaggtgctggagaggatggggagaaataggaacacttttacactgttggtgggattgtaaactagtacattcttaacatcaatttattcctaaaagcaatgttcatagggcacactgtaggccatagatttgcctcacaaatttaaaggcctaagccctcaacatgcacagcagtatactcagagactatttgtaaagatgacgattctggaactttttaatgaccccaatcattagcaatgattaaaattaatattcaacattctatatttaccaaggcaataaagtagactaatctattttaaaagggttttaaaatgaagagatgaaacaaaccaaatgattttgatttaaacttcatgaaaacataagttgcattaatcaggtgattttgttttatgagcattctgattgaagtgatcatatttagccccgggagaataagagaaggtaaagtatgggtatggcactgaatttactgagatgattatattgtttgagttaaagaacttgtattaagaaacaagtatgtgccaaacattgtgctaggagcaagcaatgctaaaattacatgggtagaaagagagaatgaaatatctagaatgagttagaaacatcagtgttttccaatgtggagccctgacttcacatgaaaattctcattttcaaacaaggtagtttatgaaaactggactattagcaagacagggtgggcatgccatcagtatagtacctggtgtaaaactagaaattttaatcatttgtgctttcattttataatcagtaaaatccaaggtaggacaaacttttactttttctgtataatggactgatatttgaattatacccaactttaattttttgccagaaattatgctttattgtttctctaaaatggtactatagatctttatttatttctatatatttatatgatttttacatatatgtgcatttacatgtatatacatccataaactatatacatatatacacataaattacaaatatgtgtacctacgtacatatatatgcatatatcacgcaaatacaggcacattttcaatacccctttttgatttttttccttgaagagcatagcatctgaatttattatggatttatttttaatttatggtcatgttctttgagtgcttttggtgtttatctggttgccccaaactcgctagcattgtaaagaagatgtgcaaagcctgaatctagactgactttcatattgactttattagtcaaaaaaagtagatgaaaatgtaacagtccgtgttaaaaatgggaataagacagatgttcaagccctagcttcagcagtttttagctgagatttactggaagaaaacattttctgaactgtaaaacatgcaaaatgcctacgtgacagacttcattaacattattaaatgctatgatatagtaaaagaatttgtaaactgtcaagtgctttgtcaacattaggaatttagttattataggtatttccatatacatgttgtatttagaattccctttaattttatacttagggttgatttgtattttaactaagtcactttatatatctggtcccattatacaagtatacttttccttaggataagaaagtgatctttatatatgtttatcaacccaaatgcccatcagtgatggactggataaagaaaaggtggcacatacacaccatggaatactatgaatccataaaaaagaacgagttcatgtcctttgaagggacatggataaagctggaagccatcatcctcagcaaactaacacaggaatggaaaaacagacaccgcattttctcactcataattgggagttgagcaatgagaacacatggacaccgggaggggaacatcacacaccgaggcctgtcgcgaggtggggggcaaggggagggagagcattaggacaaatacctaatgcatgcggggcttaaaacctaaatgacgggttcataggtgcagcaaaccactatggcacatgtgtacctatgtaacaaatctgcacgttctgcacatgtttcccagaacttaaaatttaaaaaactttaaaaaaagaactgtagatactgatccaaaaaaaatgttcattaatgggggttaaatgattatttctaagtagactactcttgaacccttgaatctttaagaattttctttgctattgaagccattcaaactctattttattaaagctgtcgttattctagtagattttaaacagtaatacctgaatacattagaaatatgcaaatctgcattacatatggcatctgcagagcagaggagtttggtcatctggactcatgctaaagtctccgaaaaatccgcttgtcttaatgatggttgactcgctaatgctatgcgtatatagtcttattttaagtgattgaatgatgtggctaataacccctctgttagatgcactcagaacctcacctacctgggtcctcagctctccagtgaaatctctactttaagtttattttctaacatggtaagagccttcagtttatgttatgctcaggcccgtcactgtgaataaaatattagaaatggactttttttttttgtatttttttaatggatcccttggaactttaaaaaaattatttatttgagctttctactgttatcacagtgtctcctaagcatggcctcccgttttttgttggtaatataattcttacgttattcaaattagtaaccattatttttctcatggctagaattctggaaactattaggaaatcactgagcataattgaatggctgtttatttgaagagctatgtcaaggcagcatagagttgtattttcttgcaggggctctggagtcaaagagcctgggttcaaaccttggctccaccactttctatctgtggggcattgggcgtgttacatttgtgaaacttttgtttctccatttgtaaagtgaggtttgggggatgattaaaccagataactcatgtgaaatatttaatggaaatgtatttggtaggggatttattatttttaaatttggattgcacatgacacatgtcagggatcatgctatgcattttggatagaaagatggctaagatatcatgcctgactcttaaaaacttacctaatggtaaatgacgagttaatgggtgcagcacaccaacatggcacatgtatacgtgtgtaactaacctgcatgttgtgcacatgaaccctaaaacttaaagtataataaaaaaaaaaacttataatcaactgtagtagaaagagatctgaatggcttgccatttagctaggcacatggtatatgtgcttaattcatactagcagccactacagttgtcatgattaataatgagcttccaactgcacagaatgcttttaatccatagaaaatcaaatcagaaacaagtttttgtaaaattaatgtgaaaggagcaacaattaaaatgcaagattgacatttattttctaaattggttctattttctttcacatttacaaaatttataagaaaattctttatttctatgtgatataaagaactagaatgtactttgatgtgaattattgttgccagtgctgttcaacttttatccataatttactaagcacctacatttagacaaaggcattatccatccctttggggaggatttcagatgattcatacacagacctggtctcgaggaatttaagattttctttggggagggaaataaggactttaaccaactcaagagtacttagagaattttctgaaaataattttatcaatgaaaacttgttatattaaaagaaactgtcattctgacttccacaaatctaggcttgaaactatggataacgagatattttctattactctcactcacgtcattttcacaaagtgaaaaggtacattttaactagtgaaagaatagaggaaatggaagtagctcgaggcagtggacgatgattcaaaaagacagggccctattatttgatcaagttatgcaacgactctgggcctgtttcttcacctctggaaggaggaataatctccaagccctttcagactcttttggtaattcacctccagcacatcttctaaatgccagcattaactgtcctctgatttgtctcatgtttttctagccccatgctctcctgttcgccatttaccctcatgcaaggtacaaattacacccatcatcacaagacacttgctcaagtcccattgcccccttgaagacctgccacacctactctctcaaaaaccatcatttcctgaaagtcctatacagctcatttggtatttacagtgtactgccacaagccactaagcatcgttttgtgaatacatgacttacagacttagcttgagtaaagatacttgaaaatgaacaccatttcttggctatcttcctattttgatgtacccttcaggcctatgaattttagtataatagataaccaataattatttcttggttctttcctgcacatctgaataaccctatgcaaagtgatagaatgtttttctataaggaggtcctacactggagattgtgtatttcttaatgctgttgaaggaagagatgtgtatctaaaataaatagactctaacaaacattaatttatatttctattatctgttttgtgtattgagatatctcacaaaaataactaaacattttggcattattgatattacatatttgccatgaatatttgtaaatgaagaaaaatatatatacatcagtaattatcttggcaaactcttcaattatgcaatattgttacatagattacatatctaagtgaacactggagttttaacaatattgtgtgttcataaatgttttatttattattgccactaattcttattgccatttcaagaactatgtataagttgttctaaaaactattaaagtataggtgaccatggtcactactgcctactttggtaaaggccaaatatgtgaagactttttaatgtgttaacaaacgttgaaggttttttaacctgttaacaatcagtaggactcttgaaattatttcctaagagagtaaattttacaacttgcaaagcatgattaacctcttgtaattataaaccatctcttgtagttatgtagcattttgttaatgagcaaagaaccattgtggttcctttttacatttcttaaaataattctccgtaacctcattgatatctccagtaaatttagataagcttttttttttaaaggagggttaaaatgacattttaaactaatttttcttgttagttatacagagttgaactatctgagggttttattgacagtcataaaaaatttgttattttctgtgaaatatagagaatttaattcattatcatattattaattctgtgggccattgtcttaattctagaggcacaagctgttttcatcccactgaaatagaggaatcaaagtatgttccttgctcaaagcacaaaagtgacatactacatagtatgcttcttgagtagtcgtaaatctcatgtgttaaattacatcccaaagatttcagtatgttttatgactttaataatttatggtaatttctaatctggcctttgttgacctgtcttgctttttaaatttttagtttttcgacaaaataattaacatattttaataatcttccaaaggtgtttaaaatggcattgtatagagatagctgaaggcttttgagcttctgtgttgtaaacactttcttaataaaacatgaattgctaccagatgatccagcaatcccactactgggcatttatccaaagaaaaggaaatcagtatctttgaagagatagctttgttcccatgtttactgcagcacttttcatactagccatgatatggaatcaacctaaacgtccatcagtggatgaattgaaaagaaaatgtggtatgaaacagaaattgctgctttaatttatattaaacacactcatattcttctcagctgttaagtattgagttatagatttaaagaattctattgtgaagactaaagtgactattaaagtaagaaattattttttccattatatttaacttatttcatactttaatgttagcgccaatgagcaagactattgaatacaaaaactaattaagtagtggtgatagtacagtatataagggagaacattcttttagaaaggaacaataacagggagcaatagaaacaatgaatgagtgtaaggtcacttagtgttaaaacagctaaaatatagtacaaataagttgcgttttaatagtgattttatataattacaccttgatgttttatttgttacaagaattgtccaggaagatttctctaaagaccaaaggcactcttcccctaaataactccaaagccagtcctgtgtttctataaaaaaaaaaaaaaaaaaaaaaaaaaaaaaaaagtgaaaataacgtgatgaacatttttgaggaagtataaaaccaaaatactccactgcatagctgtttctgcaggtattgtattgatatattacattattcagctttggagtctccacatccaatgttacatcatcactctaaattaaacatgtatagataaatgaaataaatgagatagcatatgaaaatctcatagcccagcccctgcactatttaaaatagaaataccaaagaattgtattcctcatctgaaagctatttagtggtggtgtttcaaataaaaattccatctactgctgttgcttccattgtatctttttctctgcggtactgaaagagaaagagacccagaaggggccttgtctgaagtgtccctcttttaagctgttgctgctttaagcacagggtggacaaatgtaataggagtttcataaaggtggaataaaccagcggattacggtgtgggtgaatactttcagatgttaaccaggagctctgcttgcatgctgggagttgcccatgcctcttctagattgaggcacattatcatgcacaacctaactccaagaaatcttttaaaccactggaaattgaacccagaacatgtctctaagccagccttttcatcctgacaccgaatcatagcatgagccagtctgtcagggatgctgctgctctctaggcaaattttaaatgttgaaataatgaatcatgttttcttgaaaaccatgtacaccaaagaaaagttagtcattttatagatgatgaatattaacattttcttagacaatctgataaattatcagatctcacttttggctctttttaagacagttatgcctcagaaatattaataaacccccaagcccttatactgatcagtatgttcactactagctatgagaaattcttgaagttcttgtaattattgtattatttccttactttcattttattagtatgtgaataatatttttaaaaattctagtgtatgtcttgtatatattttaacaacatgacttttaattaatgtcttgataacatttcttctagtgtatgttttcagtaacatgattattaactgtaactttaaaaacctgtggattagatgggaccattttaaaatgttttaaacctggaaaatctgatggctttaggtttagttcaagctatagatcacctgtggagaatggaactgccaaaaaaaaaaatagctgtagcagccctttgagtattctaaaatagggatgttatccagagcattggtttctaaagcttccattatttattgatgttgagctttcaggatttagctacaatatttactcaacatctaagccatgcttttttatcagtcatgttttatatcttttataatcaaactgcttatcactgaaaaaaatatataagtttctatgtatctggaagaattctctggtgtttcttagatatggattttgatgtgtggaataagaattcaattcaaggataacagagatgttgtcctgaaaaaaatcgaagaaaatcagcttttctttaacattctgtcaaagctcctgactattagtttatcagcactgttttgccaaaggtgtcttctcttctcttctttgaaaaaaatcatctgctgctgctacgccgcaagtgtgttcccgctgtgcctgagaagatgtgtggcataaaaaaatgggcatggcctgagttaaaagtgctacatttaagccagagctggcttatttattagttgtctaatcataggaaaatgacagagcatgcttttctcttgcaatatccgttgctgaaaattaaacacatgagcagagctttcagagaggttgactggcctctcagacagcacctcataggatggcctgtgttgaagcatctcctttaaccagggtctgtccctcagcattgggttggctcacctagattggattgtcccagcagaaaaaaaaaacccaaaattcagaatcatatccaaaccggaatactctttcattcacattacttgtactaccttttcagaaactggatacctgagtgtgtgagggtaacttagaaacttatctcatggttagaagttttagaattagagagcgatgatcatgaaacggacttcatgatcagaagcaatggagcaaggaatgagatgtctttgaggagtatttccctgaggctgtggataacgctgacgaataatccccaccttaaaagtgggttgaccactctagtagctgtaaggtgggagggttctttcttcagagataaatctgtgctcttcacttgcccatttcccaggttttcatgtaggtagaagaaacacctgtaatctgaagacactcttccttcagctttgttagtgacagggatttaaatatgtctttcacacattttccttagatagttaaatttcacttttcctgtttgtttttctctgaaggtattctaactcccctcctaatggacttctagagctttctaattctatgcaatttctgttgatttgttctggtaaactttgaaggtaatctctgattcaacttcttggagattctatcatgtcatctctgtttattaactttatgttactcatggtttcttgatgaggactcattaaacataatgtaagtagaaaattattaactacataatatttactacgggttgttatttctgatagtagctagctgtaagattccaattgttcttcaaatctttgtctcagtgatctctgtgtagttcttgactacttcaaataacttcctagaaggatagggatttaataatctcttaataggaacacttaacacactgctggtgggaacgtaaattagttcggtcgttgaaagcagtgtggtgatttctcaaataacttacaaaagaattaccatttgacccagcaatcccattattgggcatatacccagaggaatagaaatcattctaccataaagacatatgcacgttgtgtatgttcattgcaacactactcacaatagcaaagacatggattcaacttaaatgcctatcaatgaacagactgaataaagaaaatgtggtacatatacaccatggaatactatgtggccatgaaaaagaatgagatcatgtcctttgcagcgacatggatggagccagtggccattatccttagcaaacttatatggaaacagaaaaccaaatactgcgtgttctcacttataaatggaagctaaatgatgagaacatatggacacaaagaggggaataacacacactggggcctactggagggtggaacacaagtggagggagaagatcaggaaaaataattattgggtactatgtttagtacctgcgtgagaaaataatctttacaccaaacccccgcaaaatgcagttcacctgtatagcaaacctgcacgtgtacccctgaacctaatttaaaagttataaaataaacgtatcttattttcagtacaatacaccacagagtagaagggttaaaagagattgcttctgaggaggtgagatgggggtaaggacagcacaagagcattttggggggtgatgaagctgttctgtgtcttgcctgcgatgatggctacacgactaagcccttgtcagaactcacagaactttacttcaaaaggagcggattttactacacatcaattccaataacaaatactttgtctttaagcaaagggatacctaaatatagcgtattgaatggatctccagaaaaacacatttttcagttcatgtttcagcctaggcctcatctcatccaggaaaccttgtcttgcttgcctttacatacatgtggcaatcagtagtttcttttagggctcggactgaacactcaatgaacttcaatcttagcgcttgtcgtagcagattgacatggtttatttatatgtgtcattctctgtagtaaaaggaaaggatcaaggccattcacttttgtagtgattgtgcatggcagtatttggcacatagtagattattaattatggaacttctgttttcacacacacacacacacacacacacacacacacttcagagctattttcatttaaatatttgctttagtctccaaagcccctctgcctcaacaccaacccttctatctcattattcatcagcttttctcctattacgaaactacttaggaaagcccacttatttagcttatgatggcaaaaataaatatttgtacttttttttttttttttagtcatcgcttcatagaacagcctctgtcctctgcttatgccatgtctgaatatatgctggaggtaaaaagagttcctggttgagagcttcaatttgagaaactatctgagattactttccaggttccaccgtggaacctgtctgaccttgaacaaatgacctcgaacaagtggctgaaatctcttctatttcgtcaactgtaaaatgggggaaaaccatgtctatctcatggggttcatgtgaaggttaagaaattgcttattcagtgtttagcacagtgcctgatatgcataaagctcctaggaatattagctgttattgtatttccttaaagaagcccatagctctatatgccctttcattatatgttttagtagcccaatttaacatatggataaaatatttttaagttaaatgatttgctaatggattgttgaacgagtggcagacacccatattatagacgaaggtcaagtccataacatacagtacatttccccactttcatttcccattaccaaaattcattattctcctgagaaactcattatagaattcatgtcagattcatctgtgtgttcccagcagtgccttatatccagaaataacactgagtcattgtctagatgtagcagaggtggaatcctccaaagagaagcctcagagtggccaggtttgccaagtatagggatgccttgattactggccttactctttatgctcgtgaattcctaagttttattcctcctgtagtcatagattggcttttaagctacaagctgaagagagagaaaacctcttccacctcgttggaatatgtctcttcaatccatttgagccaatttaggacatgagactgctcttagtctagaaccagtcatcaggagaattccaggtctgattgactcggactagcgggtcaatatcagggcaaaaattccaacgcacaacacgatgtatcagtaaggagaacctcaaaattatttcttaacgtccagatcatgttcctatttttatatatctattttctcacataagtcattaaaatgatgtacctgtgcgggtcctttaatgatactcaaagatcttgaattataggctaataactaacttaataagctgcagaaattaacatttctgctacgtttatgtagcattttcccacatgtacttcagaggcttgagaaaagaccctgaaataatgactgaataacagctttactcacttaatttcaaatttgttaattcttctgggaaataccgtcaacatccattttattatttttctcaattacatgtacgtttctacatcagtggataagttaaggagaagaattccctcatgataattttttcatgctcgaaaattttgaatcaattttttattttacattatactctttcctagtcattagaaagggagtggtggttaagataggcaagaatgctttataaggatactactctcgtttcaattcttaacatcaaaaaccttaacagtgtgtagactataaaataaaatatctagggatcagagcattgtgctgaactttgcaggttttttagtcaataatatatatgacgtgttcacagaattctttgtcaacaaagtacttttggagctccaggccatttaagttggtttttgtactttttctttttcttcggaagactttttttgttctatttacctggaagtgtttcttttttggtactgtgaattaaaatgagaccaatctactaggcaggaaaaaaccttaattagattgttgacacagacaaataagaatgtcaattagcatctactgtcacatgcctctccagactgcttctaggatgagtggcctcaagcagctacatcatctttatactcctaaagcatcaaggaaacttggagtgacaattcatatcatgaacacatccacagtgatgatgattgtgcttcttcccccccacccaacaacaaaggatgaatgccaattaatgtattcagttttttgcgtcaaaggctggatcacttgtgcaatgagggtaatcatcctgaccagacaggccatacaatccatattgtgtgaattaaagataatatgcgtgaaacaccttactctggatgtggttcatagcagtagcaaaaagatgaaaactatggtatgctaacattttagagatctgtactctattttaaataattttataaaagtgcatatacaataaaaagtgcacgtatcacaagtatatgcctcaaaatctaaagccagtcatgtaatcagcatccacttcaagaaagaaaacaaaacagtacccctggttcctctttgcaatcattagtctcccaagagtaatcaccgatctgatctgtgacagcatagattggttttgccctactatatttttgctgaattatacaatatatgctctttaatgtctggcttcttagtgcattgtatttgtgtatcagctattctcttgtgtgtagttattaaacaatcattttatgggctgcataatattccatagggtaaatataacagttttattgataacttagctattacaaatagtgctgttgcagacatatattctattacatgtcttttggtataagaatttacacatttcacatgggtgtatacccagaactgagattgctaaatattggggcacattgtatacattttgatttagtagataagatattgccagatatcgtaaatgcacagtttgataaatatagagatttatactttttctagagaaaagccatcaatatcagtgtatgtgtatatatatacgcgtgtgtatatatacgtatatatatacgcgtgtgtatatatacgtatatatacacacatatatatacgtatatatgtgtatatatatacgtatatatatacacatatatacatatatgtgtgtgtgtatatatatatatgaaacaactcagaagcagaaagataccccatgttctcacttataagtgaaagacaaataatgtataaacatgtacacatggacatagagtgtgtagtgataagcattggagactgaagtgtgggggtgtgcaagggaatcagtgataaattaatggctacaatgtacataatttgggtgatggatacactaaaaatccaaagttcaccactatccaacatactcacataataaaattgcacttgtaccccttacattcatacaaataaaaaattatttaaataaaaataaatatgtgtatatgtatgcatacatacatatgcatatacatatgtgtttgtgtgtgtgtatataacttacacttaaaataagcatggatgctgcaatgaatgctcaatttacaagggttgtccatccaaacttgtggcaagtatctcacctctcaagttgttttcttttttcttcatatatttcttgcttttgtctaggaaggaataatttggcttgcctttcaagagtgtacagtcagcatgataacccaaacacttaagacacgtgctaacccatgtggatcccttgagagaaggaaaacagtggtccttttactgggcagatagagcccggggccaggtttcgtggcttgaagatttcagcttctctgcgcctctcagctcagtgcctctggaagcaatttacaacttgtgaggccatactcaaaggccctgttattaattccccgccttccgagaccccatttcagaggatctcaattgctctcagagtgaatttactgtttcctgaattccgtaatcccaatagcaggtctgttgtcctcattagatagcttaagttagagtcggcagtgtaattggcaactgagctactaagtatccaatgcttatgtggaaaatatgttccctattgcaaacaactgatattcatattcaatttggcaccatcatctatctataaagcagatactacttgtgtttattaagttttatcccaaataattattttagtaataatgcttgaaaataggccttggtcatttgcatgtctgtatatggcatatcctgagtctttgtatgtattagaaagatcactcgttttgacttgatggtttaataaaagatgtccctcactttgggcagagacatttgaaaaaggcactccaaccagggacctaagaggtgaatgagatgcagctctgaatcaggtcacacggcctcaggaaggaaacatcttggttttcacatccctcacttctcgatgtcatgtgcaatacacaaatgacccctcaacacacacacaggcacatacacaaacacacactcactcactcactgtattgtctctttccttgactaagtccttcttactaactcaagctctaaagcttttttacttacctaaggtgagtgtgtgaggatttgaggtttcaatattaaaattcagaaacatttaaagttcattttaaatattagtaaaaaaaaatcttgacaaaatacaattatagacaaaaagaaaattcagaatatttggaatttaaggttgaggttacagccctatttatgaaatattagaagaaaaatgctggagagaataaagcaggtttatgagtctgatagaaagcataaccagatgattatgcatatatttgcatatgcaaagctttctaggcaatctgaacatttaaacctacaaatgtggctgcgatgaacagccacagaagagcaggctagaacagaagaggaggctagaacagaagagcaggcagaagttgtaaatgaaatgttaattttcaatggttgatctcccaagtactggaacagatttgtgctgttttcaaggttttggttcaaagaatccagtagtgtattgaattgttttgtggcacttccctgttattttgctttgtaagctacctcaatccatgaagtggctatgagccccttatacaacactgttgatttttttttccttatctacgcaaaagatttttgattcagggccaggcatggtggctcacgcctgtaatcccagcactttgggaggccgaggcaggcggatcatgaggtcaggagatagagaccatcctggctaacacggtgaaaacccacctctactacaaatacaaaaaatcagccgggcgtagtggcatgtgccggtagtcccagctactcgggaggctgaggcaggagaatcacttgaacccggtagccgagatcctgccactccactccagcctgggcgacagagccagactccatctcaaaaaaagaaaaaaaaaaaagattttttattcaggtggctatcagactcattaaatagaagccttaggttaagttcacgggttgctagttggaagcctccatggactatgttcataaaataatagaaaggagttatgcaggacttcttgaaatgttatttaaaaagtcagaataggctttctattacttgtctgaggtcaaatacatgtagtgctttctgaccatttcatccagggtgttagctaggacaataagaggtgcttaaaaattattagattgagtaaatgagaaagcccttagaaacataggaacagaatgacccttgctttggatctaatattgactcccacgcctaaatccctttggagaactcctttattttctcttccatcaagagcaggtataaattaaaaacaccattaaaggggccatctagctcagctgaagctttcatcacacatgtaggggaggtatggttgggagggatctttttatcctttaggtcttcaatttacataggacttttgaataatcaaatagccccaaagagctgatcttaggactagttgtaattgagactatttctccatggggtagaaaaatctagttgtaggaaaactgagaagtagatgtatgttaacctcaaaggctgttttttacaaaggatgttaaagcatcatctttgctcagaaagggagcaataaaacaaatgagtggaaataacaaaaggaaataatggccaggtgcagtgcctcacactagtaatcccaacactggggggctgtggtgtaaggatcgcttgaggctagcagttcaagaccagcctgagtaaaataggcctcatctctacaaaatagatagatagatagatagatagatagatagatagatagatagatagccgggcgaggtagtgtgcccctgtagccccagctactcaggaggctgagatgggagaatcgtttgagcccatgaggtcaagtctatggtgagctgtgctccctcctgccactgcactccagcctgggtgacagagtgagatcctgtctcgaaaacaaaaggcatactttttagatgtaatggaatagagtacttccaaacctggctgcctgctggagttgtattggaagaggttgcacgacttcagtggagatggcctagatgcctgctcagcagtcatctagttaaagcaactaagaacatgtaatatgaaactgcaaaaagagatcgtgtacgtaaaatcactctgggctcctcagatagagtaataaacacaactcctgacagccaaataaaaagagaaataatacagcccttgacttccttggttgctttgacatactaagtaggtgttacaggttgggttctctgggaaacagactctaaaacatttttatttttactttatttgttgttattattattattattattattttagacagaattttgctctcgttgtccatgttggagtgtaatggcacaatctcgtctcactgtaatttccgccttatgggttcaagtgattcttctgcctcaaactcccaagtatctgggattacaggcaagtactaccacgcctggctaattttgtatttttagtagagacggggtttcatcatgttggtcaggctggtctcaaacacccgacctcaggtgatccacccacttctgcctcccaaagtgctgggattacaggcgtgagccactacgcccggccagactctaaaataaagtttaatatgcagaatacttatcagggaatgcccactggaccaatacatattcaagagagggcttagaagcaggattggacagaaagagaagttgagctgtaatgcaggcccaataacagccttagtgttaagcaggctgagagattcagcagttaatgagacagtcaacccaaacagttttataggcatcaaaagtatgatcagcatggtgtcagtttcctgtgtcacttgtcccacagtatgataccaaaattaaagagaccagatgacatgcaacacaagcagtgtgcactctgttgttgagaagccaatttcgtcatgcaattaagcagttttatactctgcagctgtactttaaggggagctgagatggaacatcatatgtctcaccataaccagaaaggcagatgagaaatgttctatcgccacctcccacaaggtaagggacttccctaaagatacagaggtgggtggaatattgccttggtagacttcctctcaagactgcctatcttcccatgttggaaggatcacagagcatttgtcaagacgtgggtcaatctgcagttgaactttgtgtatgtggcctatgtggatacttataatatcattgggcacctccatagagctgtttcccaattgaccaaacatatgggaagcttcagagcttcgaatgacccttcagagtagtcctgagaacagtgagccttactactcctgcattaatcagtcattggatgatagccttctcagaaataagtcatgaccttgtgcaagggggctcttcatggctgggaccacccctaaaactgagagctgaaggctgtctgccaccagcccttccacctgctgggacaagttctttattgaagggaaatctgagtagttcatcagcgtccatcacagtagtcaagccgttcattcttccttcttatgacaacattgtgcttattgttatgtaatccctttccagaacattttaggttaagttttaaaaataatgcatataaatagacaattcaaatactggggaaaaaaagcttgcacttatattgttatagaaatgtgcacacttaaagagctgatttcttctgggtatttacataactttatttaaaaatccatccatttttaattagctgtttttaatatgcagttagctaagatattataagccatatattaggctaatggacatttaacagcttagttaagttcttttaatggaaatgctgacaaacctttgtctgtaattatagcaacactgtgattacagaaggaggtgcctctccttgttgtttgcagccctaaaattccatgtggctataagtaacaaagtccattattagataaacacaagtcatacttggcattacttgcattactcgtctccttgctttatttgaatcattttttaaagttgtaaaatgtttttcaaaactcagaatagtggccagttaataatatgattcctcttatattatgagattttaaaaaatagttcaccagtttctggtggcctctatacccattggcaagtcctagccattgtgaattaagtaaacaattctttatggaaattttttaatccttaaaccctataagtttttattcatcatgtcaggtcacttgtcaaagggtttaacattcagaattcaacaaaagtttatcaaacacctattacaggacgtgcaattttgggcgcactgggatttcagcaattaacaatcaagatatgatttgtatcgacatggatattacattctctcacaggagacagaaaacaaaataactagaaaatatacataaagagactttaaaatggggtaaaattacagattgtgacaggatgaccactttggttcagaatatctaggacatttttttctttttttttcccctccctccctctttcttttttttctttttctttttctttcttttctttctttttctttctgcctttcggagtcttgctctgttgcccaggctggagcgcagtggtgcaatctcagctcactgcaacctctgcctcccatgttcaagcttttcgtgtgcctccgcctcccaaataactgggactagaggcatgcaccaccaggcccagctgatttttgtatttttagtagagatggggtttgaccatgttgcccaggctggtctcaaacttctgacctcaagcgatccacccgcctcagcctcccaaagtgctgggatttacaggcgtgacccaccaggcccaagcaaggacatttttttctgagccatgttatttaaacagagatctgaatgacaagaaggggccagctctgtgatgtaggggaagaaaaatatgttccttctacccttctaggctgcccagctggagtcctacaaagttagagtgacaaaagacagattaacaagaggaaaagcctagaagtttattaaaatattcagtgcacatacacctggtagaaactcagtgatgagtaactcaaaggggtggttagaatgttgggtttatatagcatctgaacaaagaacagtaaacttgtagagaaatgacaaaacaaagaaaaaaggggtttaggtatttagggttgccaaactgtaggaaggtaaatatatgggagaaacatggagtatagtttgtttatgccaagtctatcttgagatcaacttttcgtattcttcatggccataacaatttcccaggagagagggcttatagcagttatcatttctcagaagtttctgcttttatttagacaagggaagcactgggaaggcttctttttgcttatattgattcttacttgcctctaactaaaagtaatctttatgtcaaagtgccatattttggagtggtatatattgatctcctataataacaatcaaaaggaacagtattctaggcaggagtaccactaatgcatagtgtttggtgtaaagacaagttaacatattcatggggcaacaacaacaataagccaatatggctaagacattgaggatgagtgagttggagaagtaggcaatggccagctcatataaagacttgttcgtttttataaattgtttagattttattgtaattatggtggcaagtgattggagagtattagcttcactttgactggcttatcgaaaacggaatgtagggggtgaaagtggaataaaaagaccagtcattaattgagtagtccgtgtgagagatgatagtggcttggacaaggacgattgtactggagagattgaagcgactgatttcagatttgtagtcaacaaggcttaattggtaggagaaaaaaataaatcagtgttaactctttaatgtttaacttgaataattatgatgagggtattaccatttattgagatgtagaatattataaagtaagagcagatttgttcaaaaagtatcaagaatctttatttggacatgctagtttggggatgcttattagagaccctaggaaactgaatataaatgtggattttagagaagagcttagggctggcagatgcacattaaggatctgtctagagccatggcgctagagacctccaggagaacataaatagtctcaagatcaagccctgagacactcagatgtttagaagtggaacagaagagggacatccaatatagaataccaagaattaggaggggaatcaagagagtgtggcaatatgaaagatacaaaaagagtgttgaagggagggagtaattaataaccagcatgttatgaggggctcagtataatgaaaagataagtgactattggatttggcaacatataattttttggtgatctggacaagagcaatttgaacagaatgatggatatggaaggtccagaggagtaggctgagtaaataatataaggtgggaaaatagatacaaagattatagacaactttttcaagaagttttactgtgaaggggcacagcaagctgagacagtgaggataaataatagactcaaggatggtaactttagaataagaaatttcaatctgatgggatttaagtgttagcaaggaagctttaagaagttattttccccattagaatgatctgaaaaatgttttagaacattcctcttatattctattttatcacatttatataactttcagagaattgaaagaggtattaagttattatgaaattttctgagattaataagataacaattataggatgttttcttttagttgaaatacacctactcagcctaatttttataacttcttactgaagtataatatacttcagtagaaaagcatgcctaatataaaggtgcagctagatgaatttgcacaaactgaacacatccctttaaccagcacttagattaaaaacagaaccttgatgatacctcagaggcccccttctgccccttttcagtctctccgtgctacccccatggataagcattatcgtgatttctaataccatagattaattttgccagtttttgaattttatgcaaatggatctatttcacctaattgtaaatatataacattgtcatagcaaggcactcattgccttacactgaaaattacattgactctttgccacaagcttagacttgctttctcattttattatcatcaagcctatagctttcacactataccttgttcctgctcttccctactctatttcttggtagatattctatatcagtcttagagtgcagtttgcagaacccctccatcagaatctcctagggagcttgttaataatgcagattcctaggcccctcccatggtttatgaatctgagagtgaggcagacaagactataccctctcatgcctctataatgtaataatgtcttcctagaatgttctttgctgcatctcttattaaagaaatcttatgggccgggcagggtggctcacgcctgtaatcccagcactttgggagcctgaggcgggcggatcacatggtcaagagatcgagaccatcctggctaacacggtgaaaccccatctctactaaaaatataaaaaattagccgggcgtgctggcaggcgcctgtagtcccagctactcgggaggctgaggcaggaaaatggtgtgaacccgggaggtggagcttgcagtgagctgagatcacgacactccactccagcctgggtgacagagcgagactctgtctcaaaaaaaaaaaaaagaaagaaagaaaaaaagaagtcttatgtttcctttatggccagagcacaacattgtcatgaagtcatctaaaatttcccactagaggtaacatctccttcccctgtctagctcttttaaagcattacctccatttgccttgtatcatagctgcttgtacacctgtctgtctttccgctgaggttataatcctctggagggtcatgactttgcattcctttgtgtctcccattagcagccagcacagtgccttgcatactgttagttctaaataacttctctctctctctctctctctttttttttttttttttttttttttttttttttttgagacagagtctcgttctgtcacccaggctggagtgcagtgcaatggcatggtcacagctcactgcaacctccccatcgtgggctcaaatgattctcctgcctctgtcttccagtagctgggattataagtgtctgccaccacgcctggctaatttttgtatctttagtggagacggggtttcaccatgttgcccaggctggtctcgaactcctggtctcaagcagtctgccctactcggcctcccaaagtgctgagattacaggcgtcagctgctgcgcgcatccctaaataaacttttttttttttggcatgaaatctgtaacactggaaagatgttattgccttagaataattaagagattaaatgtagaatctcaaaaacattcatttttttccatgaaaactttaccaggcctcaagggataggaaaattatgggtacagaattgagaatctgtaggaacttgcaagataaacaacggtttcacaagaaagaccttgttggagagttaaattttcagacagttgtaataacttcacattaaagttttgtcaaaaaataagtatctgcatgttttgtttgccttccaatgccctcattttatttgattttttcccataagtaactatagtgaaagcacgaaaatgtgtttctgtgtttgtgtgcctgtatgttaattgtgactgtttctattgcattgttattgcagaacctaggcacgcactctgtaggcttgggtgctttctccaactgaaaaaaatcctacatatggataaattatttttacagccagtgtttaattttacaagtggtccccctccttctgtttttaggatggcagagagaatacatatttacttaccattatcacttactcatgctttgagcttgaaggaaatgagacagaaaaatgaagtaacattaacttctctctggaactatgtttctcatattagagctttatctgaggagttcacttcctctctcttcaatgctttgttcctctccagtcgattcaaatgtcctcttaaagcagaagttccgaacctctttctgtgacttcaggagagcatgagaatgtaaatataagttttaggactaaattttcaaagactttttccactcagctctcttttcctcttcggtttgttgttgtcgttgttgttgttgtcgttgttgttgttgctgctgctgctgctgtttttccccttccacttccgtaactgagctcttagggtccatctggaatctgattgcaattaaaaaaaaaaaagtttatttttacctccttgtacgtgctttctcctaaagcaggagtcagaagccttttttctttgaagggctagttagtaaatattttaggcttgtcgtctttgtcgcaattactcaactacgctgttgtagtatgaaagcagacaatacatacctgaatgagcatggttttgttcctagcaaactttacgcacagagaaatttggatatcgtataatttttatgtgttgcaaagttgtattattcttttgatttctccccaaccatttaatatgtaaatcccattcttagcttgtgtgccatacgcacacaggcagcaaatgcgagttgtcacacaggctatagtttctgactttatgtcttaaagtaaacagtaataatcattctctttttccaaacagtccactaatctccctttgtattcagcccttgcatagtaaacgccgtttcttcatcatcctgatttttattctgagaaaatactgtatattgttcccatgcactagggttcggggaaatttaaaaggatgtaggatctccttttcattggtcctaaaattgcactggggaggcaggtcatgtttatgaacagataaatagtatcataatataatcatgcatttctatggctagcatttagaactatagcttttgatgtcatgtggtttttatatggttgattatttttttcttatttataaaatgaaaaagtttgagaatttttcatctccttaatgtattcccttatttgagggaaaagtatttacctactacataggaatttatcttaaaattttctttgtctatctatttttatggaatataatcgagcaactattttactaattaatactttaatatcattatgaaaatgttctcatatttttaaccttataagatcagataattgctatgccaatctatggttgaaatgggttcttatacttaacgctatgctctttcttctgagatgtaaaaatatgtttaaatcagaatttatataggtgtcaattcaaaatgacagtagttcattattttgattagtataaatgttcacaactaattctattctcttatctattaagtcaccaaataaagtatatttgttttaaatatttaacagtttaaattattctttgaaaacttatgagtctaaagtaagaacaattaacccattcattttgcaagtgggatagttgaattttacttgcaatccagggatttttgacagtttgaaatatacatacataccatgtatgtttaggaaaacatttaaaaagagggggttgtaaaataataatagttcttccatgattttttagccataatgtttataatataaaatatgtatactcttgttattgaatgtagtatgtttctaatttaccagaaggcaagagaataatcctggagaatttctcaaggcatcttcgaactctttgatttattgctcacatatagtaatttgccaaatgacgccctagtgaactgaaagaattaatgccccgtcctaagtcactttcaccgagggactgaaaacctgcagcattttgccaattagaggaggaaacaatctaccttgcagagtcaggagtactggataaaggagctaagagtgttgctttttttccccttcttactttaaaaatcccaattcatcccatgtctttcttaaaggctaagtgaagtagtaagtacgtttttgcaacatacgaatttagcagactggccttgtgtttatttttggccggaaccattacacttatttccaaccctctcctttatttgttggttgataatgggctaattttgaatctttactgtcaaaagaacattaagagaagcagccctgcctgcatcgcaggctatgtctgtcctttgccgagtattaaacactaaaaaaaaattaagaaaatactaacaaaatgacaaagcattaagaaaataaaactagatgttaaaggaaatgagaaaataggaaaggatgctgtacctggagtgattttttttccccaggctacctaagatgatcaaaaaagagctaatttctcttaggtttctattaaggaattactagaatatcgggcacaccaggaaactttatcagtggacctgtcctgaaccaaattttcttaatgtatatatgataatttgttaccacatcccagattattttacaggaattaaaatatatttgaaacactgacagggaaaattgggtaagacattgatagatactacaatctgtacttgaaactgcactcaaggaattcgttagtcaagaaagaacacaatgactgtgggcccctctgggttttggaacctcttttgtaaagcatttttttttttcccaaatagaagatattatttttgaaaaggttaaataaaaaatctttgttcactatatagtttcctcctaaggagtaaattaatttatataaaatattgcaatataaataacaattttaaaatctcaaaagagcagtgttttaaaaataatgtagaaacattaagaaatgacttcaaatgataagaatgtcattggagagcaaagggtttttaatattacatatcgtggcacgtatatcagcacccaaccgctcaagatacagagttctttacaaaaatcaaacagaaggaaatgtgccaccttgttcataaactatatttaataataagccaggcagataaagtcactttcacaaataatgagcaagcccatggtaatataattcatttacaataagatttatctcatggaattcttagactgtgctttgaaatttaaataattctgataaatgccaacagaatagagaaatcaattccagagcaattactaacacgttgcattacctttctaacattaatatttctcttcatacatatcattgaagagaaaatgaggatggaaaataaaaagatcaggtaatatatttgctttctcatctagggttgttatgatcttcaagatgaagttttattttttactcctagcaaatgatattcttttttattttagtttttattattttatttttctgtaaattattggggtacaggtggtatttggttacatgagtaagttcttttttttgatatttctgagattttttttttattctactttaagttttagggtacatgtgcacaacgtgcaggtttgttacgtatgtatacatgtgccatgttggtgtgctgcacccattaactcgtcatttagcattaggtatatctcctaatgctatccctcccccctccccccaccccacaacaggccccggtgtgtgatgttccccttcctgtgtccatgtgttctcattgttcaattcccacctatgagcgagaacatgcggtgtttggttttttgtccttgcgatagtttgctgagaaaaccacgaggtaccatctcacgccagttagaatggcgatcattaaaaatcaggaaacaacaggtgctggtgaggatgtggagaaacaggaacacttttacactgttggtgggactgtaaactagttcaaccattgtggaagtcagtgtggcgattcctcaggcatctagaactagaattaccatttgacccagccatcccattactgggtatatacccaaaggattataaatcatgctgctgtaaagacacatgcacatgtatgtttattgcggcactattcacaatagcaaagacttggaaccaacccaaatgtccgacaatgatagactggattaagaaaatgtggcacatatacaccatggaatactgtgcagccataaaaaaggatgagttcacgtcctttgtagggacatggatgaagctggaaaccatcattctcagcaaactattgcaatgagtaagttctttagtggtaatttgtgagatcctggtgcacccatcacacgagtagtatacactgcaccatatatgttatcttttgtccctcggcaccccttttctaccccccaagtctccaaagcccattgtatcattcttatgcctttgcatcctcatagcttagctcccacgtatcagtgagaacatatgctgtttggttttccattcctgagttacttcacttacaatgatagtctccaatcgcatccaggtcattgcaaatgctgttaattcattcctttttatggctgagtagtattcatatatatatatatagacacacgtacatacatatgtatatataccgcagtttctttatctacttgtcgattgatgggcatttgggttgatacttgcacacacatgtttatagcagcataattcacaattgcaagtgatattctcaggaagcatgatgtaagtgacagagacttactttgtagactgcactcattcacttgttctctgaatgtgctctaggcagcctgagtttctactatgtcagtgttacatagatgagaaaccccatgggtggtttccacagaggctgcaatactatttttgataccaaaaatctgtttggttttgtgagccccagatgcccatatggaaaactgaagtgttgatacctctttgtagccctctgatgaactgcatggttcaccttcctcagcagtttgagcggggtggggagagcgcctgcttcctagccatccgattggcctgaatcatcaaaaatgctatcatgaaacaggttctgtttatctgctccagattacacccatcatgttctagagtgctggtttcatgcttgaatctagatcaagcctgctttcctcccctgcctgtactccctgtggctacctacagtcctgctgctgacagataatctaaaccaatagcacctaattagcctatttgctcatgtgttttttccatcgtggtataatgtcctccttgtcaatttagggtgaaaatgtagcaacacgttgctgatggtttaatttctggaatgcaggtaatgaatgtgtttttgcttatccaagtcttcccatcagatgtcaaatatagaagaacagtgttcagaggtcctaaatttaaattggagtgagaaattcacagcgcccctgaactcaggcaaaatgcactctgacaagtcaaccagatattcacagatggtctggaggatttgaagcctaatttggtgaaataaaattaaatgagtgaaattgtatgcagtcattaatctatcaccatacttaaaatgcttcattgaaatttcttttactgcttcaaatgaaaaaagatcaaactatgttatagaaaagcattcaaaacccttacataacatagataaaacttggttggagacttacagaactttctctgctgcttcgagaaagttacagtgcccacaaatctattgctattagaatattttattgtattcaacactcaattctaccataattatgtatatgagaaaaatatttttacctataaaataattattattaccttttaaaaatctgacattcttccttttttctaaagaaacatatttagatttagcttttattttatttttgtgttgatacatagagattgtacatatttctaagattctagtgatattttgatacaagcgtataatgtgtaatgatcaaatcagggtaattgggatatccaccatctgaaacacttatcatttcttcttttcaatgccatcataccaaaaggaagtaaatagaatttcaaatataaggacagccatgattttacatacatgcctacgattccaccacaaaccataattacgtcccccaaacttttaacatttcagatactttgtcccaggtatttcatgataaggattgggctatgactctgttacagaagggccaaatgactaaaatgtctctgaacaatattgattgcaaatattctacccagttgtcaggtcaatatgttccaattcggaatttataacattgtatctctactcccaaaccatccaatctcacctacctcacttccatattatggtgggtgatctcagattatatttaagctcatggttacttgtcaagtagatatggagtttagcctaacttttgaaatttatgctgagattacccttctcattatagaattaagtaggcagtttccaagtttagatttagcaggcagtttttttcaaatcacttaaaagttatatttttttagggcattgaacaggtttgaaatcctaccaagatgtcatgtacacatagaccaatagaacagaatagagaacacataaataaaactgcacagctacagccaactgttcgtcgacaaagtcaacaaaaaaataagcattgggaaatggattaaagatttaaatgtaagacttcaagctataagaatcctagaataaaatctgggaaataccattctggacattggcttgggaaagaatttttgactaagtccttaaaagcaattgcaaaaaaaaaaaaaaaaaaaaaatgacaagcaaggacttactaaaataaagagcttctgcatggcaaaataaatgatcaacagagtaaacagacaaacaccaaatgggagaaaacttttgcaagttatgcatctgacggtggtgtaatatccagaatctatgaggaacctaaacaattgaacaaacaaaaatcataaaacatcatttaaaaaatgggcaaaagacatgaacagacatttctcaaaagaagatatacacgcagccaataaacatgaaaaatgcgtcacatcactcatcatcagagaaatgcaaatcaaaaccgcaaggagataccatctcacacccgtcagactggctttgttaaaaagtcaaaagacacccaatgctggcaaggccgcagagacaaggggatgcttatacactgttgttgggaatgttaattagttcagccactgtagaaagcagtttggacatttctcaaagaacttaaaatagaactatcatttgacccatcaatcccattactgagtagatatccaaaagaaaacaaatggttctaccaaaaagacacatgcactcacatgtttgtcacagcactatgcacaatagcaaagtaatgggatcaacataggtgtccgtcaacgttggattggataaagtaaatgttgtacacatacaccataaaatactatacagccacgaaaagaagaaaatcatatcctttgcagcaacatagatgcagctagaggccattatcctaagcaaattaacataagaacagaaaaccaaatactatatgtactcagttatgagttggagctaaatgttaggtacttatagaattgaagatggcaacagtagaaactagggactaatagaaggggaaaggaaagggggagacaagggttgaaaagctgcctattgtgtactatgcttactacctggttaatgggatcatttgtatcccaaacctcagcatcacgccatatatccaggtaacaaacctgaacatgtaccctctggatcttaaaagttgaaaaaaaaagatgtcatataaatattcgtggtcactaaaagtatctaatgtattatacataaaaataaaaattgggtgaattggaagtgtattctttgtatcaagtcatgtcggagatcctattctgctttgatcacagtgtgaattcttttgcatttttgttaccagtcacttctttatttattgaactaataattacatattctgataatctgtcagaaagataaaaacattctttgtccatgtgtctgaaaatttttaacctatttttctaatgttttaagtgagaagagcatgttaatactgaaattgtaagcagtagactgaaaaatcatcccaatccatgggttatatattgaattgcttttaactgtattactaaatattaagcttaatttattttatttctacatatccccatttccactataggtgatttgtatgaatttaggaacttccttctctcatccatttttatattaaaactcagactttctaaaacaatatttctatccatccatcgttggtaactatgtactgacatgttttgtgcatccgaaaaatgttagcattagtttgtgcgcacagaagtaattccagtcaccatatgatgagctgatttatttatttcgtaagtgtgttcattattattatctcttcagcacccaaatatataggggacttaatgatacctacaagtaaaaacggaagacaaaaacgccctgctctctacagaggttaaaatgtttttgcaacagggctctagatctcagctgtgaaagtagggacgagatgaggctaggcatgcagtgtcagtataatacaatataatcaacatgtcagcatctaatgcaggtgttgcaaaacaaaatgtacacatgggtagtcaggtaacagaaaagcatgaagtagtaagggctatctatgcaagaggttccaagctgactatatactgaaatatttaaacactatgtggggcaaataaaatggacattagaacagttcgatggtcagttggggacttctgctctttcttccagtctctgaacatatcttaaagccacaatcatctatttttatttattgttatacatttatttataagccagcacccctgtgatttaagttctgttgaaatgctgagttggaaaagatcgatggatgggggaaatttagtgcagaggttttgccccaggttcaaaatcctttataaaatattaatacatggaacaaatattgaacaattaaaccactgataagttaatcaatctgattcaaagtacacctgtgaagagggacatggcaagaaaaatattacagtaagaactagaaacattccttcatggctgcttgatatggatatgtcatgtttaagaaaattcttctttagactgttgagattttttttcctgacaaagaagattcactgtcgaggaaagaaagaggtactgtgaaatttgttattgaaaacatgcacatacttttgtcagaatgagttaaagagtgaacaaaatgtgcctattacttacgtgttgtgctgttttaattcaagattaaaatatttaacgtccacagacaagaccacttttatatgaatattatttttctgctttattgctcaattttattaccatttcaaaacacccgtgttgctttctatggccaaagatgtttagcacttttcatggttatacttctgtacagtccaaaatacaacacttactttacacatacacaaacatccaatgtattttgttttctgtcaagtaaagacaatgtctgtgttattaagttaaatgtcactttcaaatacaggatatgttgatattagaatgttcaactttatttcctcatttaagcaaattacagtgtgaagaatgtaactgcagcaatttataaaaatcatatcacattcaattatgagagcaaacttgttttgtagacttgaactagtttcaattaatcttggagttatcatttcaaaaattctaaacagagagaaatacggagtgtaataatggtaggtctttgggtaagctgcttccaggaaaagaaagcaattatatatgttcacatagcactgacaaggagaaacaaaactttggacggcaaagaacttgcattagtctttttgacatgttcctgtggtgtgatttattacgtagacaatcagctcaacttctcaagtttgatatccttggaatcatttgaaatttaaattttaatgaaaattcattaattccaaggccaaaagaagtgattctaattgcttttgagaatcagactatgaaagaattctttggcaaacttgcactgtcttttctcttttatcattggttgcttcgtaggtacttaattgaaggtcctctgattatcagcacgggctgacatcagttcactccatgcattttaaacagtaggccagatgtttaaaggatcagctgaagcatcgatagcatgctagggtgaataataaaattttcattatctacaagaagcaaataaaaagcataagcattttcccccattatcctgaaggagaagatgaatgcctaagcaacattttaagaatgggttgagtgtggcctgtgggaaaatttgggtagaaaacttgtagttagctaatgtatatactgtttgcctctttagctcaccatatacccacacacatgggcatgcatgcatacagacagacacatacaatacacacaacaaacaggaaattcagatatactgaagaaatgtatttaagggattactaagtttttgtaaataaaatcctttaagatgctgagaaacaatggaagagaagtaggacatgatggctcatactttcgtaatttacttgtttaacgtttgccaaggtttaaattaatgtagatgtttttgtggctaggattaatgatctaacagtttggaataattaggcacttttatcacctagaaagcccagaaacccagcatgcaaaaattctggtatgtctgcattttacacttagatataacagagaaatgacaagtagtcaagtggatagagaaacgaatgattcttcacacatgcacacacacatagaaattgtctttttaatagtattttaatgtaacacatttatgcataatttctccatagtgtttatcttatagtgaatatgtgatgaatagtctctaacattagtggttttatagattaaacataattaaggctttatatattaaagagtcaattggtgacattctaatataaacatgtttatctcatatacattgaaatattagataattcattcgttgagaataaatcgaatgagtcaaaacttttaacctccactttgagctttgtaatagtatccactgaaaatattcatgaaaatttttaagtcatttctatttatatattcagtccaaacatctcacaagtttaaaatgtaaactcaagaatataatttctgtattctacaattggaagcatccatcatatcagatgaacttatatagtttgtgaaattttgcaaactttctgtttagtaaatcttaatgtcaaacattttaacttccaggttgtctttcttttcagttttaatatccgcgatctttgtatactcgttgaatggattctcaataagtaacccacaaatatatatacatactatgtacctacaaaaaataataaaaagtaaagaaatcgacacttatccatacctgtcccatagtaataaactattcataagtatatttgaaagatatgagaatcataaaagttcgtgtttgcacccttttgtgcgtggaatcctaggtttgcattttgtggatctagactttttggagtgtggaaataaatgaaacaaataatcgagacccagtcttatattcaggttatcattttactacataaagcataaataacatttgcagtttgtttctatggctagctctaaagtcttagcaacgagaacattatagaaagacttcaactgtagcttccagcagaacttctgaggttccgtttatggactaagcagcagttgagggggacaaaactcataggcaattgatcactccaaaggatagattgtcttttctaacctaatcaaaagatttatagtgaaggcatattcagattttgttgaaggatatggatatataatcatgtgtgtgtgtgtgtgtgtgtgtgtgttagacatacttaaaacattatttgagtagaaaattctgcacaaatggaaaagtataacatgtgttatatccacacatgttgagcatttacctggctgaaacatcaaaagctgaattgacttaattgaatgttgaatacttaatagttactttgtagtgactcactattaaaacattatctcaagctttgtcagaattaatttttttaaaaaactcagattagtgtcaggtttactgaaacagcagatctgaaattactgtgtttttttttcctttcaataatcagtttctaatccaaaattgaatatcagttccaactctacattcagtttctgttttacttgtttggactggcttttggttctgttttccacatagatcctctctgtgtaagacaaagccatttgtgcagattaaattttactgagcgtgttaacctatttaaaacattcatccaaaaagactagtatgaattcttcatatggcaagctgcttgttttaaaacttccatttattctaaaatcctttttacttatactttttaagaaacgtattcccgatatacaaaagtaacacatgctcattaaaacaaattaaaaatagtattgtataaagagctgatacatttctgccttgccccatttaactttcttaagtgttcatgtgaatcatccattcacatcaagacatttatctgtattcatatgaacgtgttttaatatatataacatatatagaattttatataaactttccttttaaaatagaaatgaaattatatgatatatttattctgtgtctagctcttgtcacgtaattattcaagaacatatttctaggttaatatctgtattcttaggtagcattcactaactcctcatctacttgttttcttccattctaattgtgtttaacatttcttcatacaattggttgtcatttggtcttctttcatggagggtgcataatgttcattctcaccaattctttacactttacataactgcttgatacgaagccagaccttataaatatcaacaaagcaggaacactgtaatcagctatcagtttcagttgagctgaatgaccctgaatatgtgtacacatattttccaggagattttaaaactgacacctcagatttctaagacctggagaaatcagcatgagaaacattgatctatattattccgtgaaatgatttcactaaatagtgaagcatctcccacatgtggactctgtaatttattagaataaagagttcatgtgcttctgaagaacttgaactactcttctggcctccgtacattggtttcttagctataggaaggctgagcatgtttttcctatgcgtttcctttctagctcatcattttagtgacaaaacaatctttcgtggtgttgctctagctatagaattgtttcagattcatttgaccaaaggtggcaaatacaacagtcccaacaaaaacaaaagacctattacagaatgatggaaatgaccccagggaacaatggcacctccacatttcttaattccaaggttataagcagtggtgtggacaattctcaattccaatgctgaatcgccttctaatttcaaatacctgtgctaaaaattatttacgtctactgaaataatgaactggaccccaccaggaatggccgatatgcttgtagtcagagcacaactgtagaaagaaaataacattttaatttatagaggtatgatgatagctgtttcatactgttttcagaacgatgaatggcctgctcagtagtttcttgtcatcgtactgagacactttaatttcttaccagctgagatgaggaatacgagcccagtgtgcaggtgaaattggttaacaggagccattaaaatttggaagagtcagaatagcatcaatcaaaatgctttcagtgtaggaagtaaacatgtactagcctgacccacctgtcttttcttttaggtatgttggtaatattacaatcattttgaggtatccataaacaactgcttagatctgaagaattgtatatctttctttactctgccctggcctggggttatggttctcattgagctctaacctttcagaaaaaaaatgtagagaagtggttcaagaagaatgctttatcttgcttcataaaaatgatagtgatagttttattgaaggcttactatgtgccaggccaaagtgcgttttattatcgttcccattttccaggcaaagaagctggagcacagagaggctaagtgagttgtccaggatggctcagctaacatgctgcagttgggatttgcacccagaccaacttcttttcaaccactgtcccatcctgtgtcttctctactcaaaaagtgtttcagctccaaacctgaaactttaaagaaaaggaaatccttagtggaaagactaggttttagtcacaaattatctccttccttacattatttgtctctttttcaaatactccaagctttgattaaaactgtctatcactaggaacattgtagaattgctaaggtggaattgttaaaagaactcaattccaattaactttgccattgattactgtgtgttctggaggggtgttctttctttcaggttaatgatgctttattgtatatctcaaagattaaaaataacaatgaaggaagtagcaaaccggaacttctctcacaatgcatctttcaatctcgtgctttaaatgaagataaaatcatggctgtggtaaggttgcaggaaggatgatatagattaagtttcttgcaaactgccctctgaattttcaatagctgtagaaggtattggttttccaaaaaattgacaaattgaggattcattcagcagtttttttctaggtctcttaccagaaagtgatcactaaaaagtgtagggaaaccactcaaagttggatagatcattattttcacttaagcattttaatttcttgaaggagctttataatgcaacaaagaatttacagtcctgtgtcaccgcttaaattttctagggtcatcagtaaactcagtggaaataaattagttcatgaatataattgacccttaaattctgtcactgtgcaagtaatcggtgggtctgctggatatggctttcgagcagacaggtcaacttcttcaaacagagaagaagcatagcataaattgaagacaaataacaaactacttgtttcctccttctttggcatcaccctatggatggagtatgcatttataatttaacacaatcaagagatctttattatcctacttttgggtacaactgcttcgtttctcttttgaatctctacagctatttaaaaatctgttttgtaaaattctttaaaaaactaaaacatcagattcatatttcaggtatcttactatcttataccaacttaagcatccagtattatcacccacccttcccctgagtgaatccttagcactgggctcttcctgttttatccctgtgcatgctgagctctttctggccttcaagtctacttccgttgcaactgttgtctgaatggtctctctatgtccttcttactctctaaatatttcggaatttaaagcctggaataatctaccttagtccaaaagatatgctacactattctagttcacaatgatctcacactgccgttgatacacaacatttaatatcaacttaatatctatttcagttcattacgaggtcacttatgctacatcttatattgttgccttggacttttattatctcttcatatatgtgtttatggtgctcccaccctcacgagaagttgcaaataccatgttagctgtctgatggctttctatgttgtcaggtataccatttcccaaccagttggcattcaatgattaagttcattaacaaagaattgtatgtgttgaaaaagatgtttttttcttaatgaagcacttgtttttatttttttaatgaaatccaccctcttaataaattttaagtgcacaatacagtattgttaaatataagcaaaatgttgcatagcagatctttataatttttttaaccctacatgcctgatagtctatacccattgcacagcatctcaccatttcttccctcctccagcccttagcaaccaccattgtactttctgtttctataattttgactactttagatacctcatgtaagtggatgcgtgcagtatttgtccttttacgacttgcttattttatttagcaaaatggctacaagattcatccacattgtagcatatggtaagatttcctttttgtggcagaatgatattccattgtatgtatataacatagctttatacattcccctgtcaatagacatttagtttgttcacacctcttggctactgtaaaaatgctacaataaacatgggaatgcagatatctcttcaagatcctaaattgaattcgtttagataaatatccagatgcgggattgctagatcttatggtagttatattttttatttttttgaggaaactccatattgttttccacaaaagctgcacaattttatatttccaccagcagtctacatctccaattttcctacaccttcaccaacacatgtaatgatcttgggctttttttttttttttttttaataatggttatcctaatccgtgaggtagtatatcattgtggatttgatttgcatttccctggtagttagtgatgttgaacatcttttcatataactgttggtcattttaatgtcttctttggagaaatatctattcaattcctttgttcactttaaaaattgggttgttcgaatttttgttgttgttgttattacgttcctcatgtattttagatattgacaccttatcagatatatggtttgcaaaccttttctctcattctataggttgcttttaattctgttgattgtttcccttgctttgtagaagctttttagtttgatatatttctgcttatctagttttgtttttgttggctgtccttttagcgtcatatccaaaaaaaattattgtgaagaccaatgtcaggaaatttttcccttatgttttcttctatgagtttcatagtttcagatcttatttttaagtctttactccatttcattttgagttgatttttatgtatagtttaagttaaaggtccaattccattctttgcaatgtgtatatccagttttcccagcaccattggttgaagaggatatcctttcccagttgtgtattcttggcacccctattgaaggtgatgctaggtttatttctgggatctctattctgttccattggtctatatgtctgcctttatgacactatcgtgcgctcttgactgaggtagctttggtaattcattttgaaactagcaagtgtgatgcctccagtttattcttcttcctcaagactgttttggctatttggagtcgtttgtggtttcatatgaattttaggaaatttaccttatttctgtaaaaaatgcgattgggattatgataggaattacactgtatctgtagatggtttggatatatagacttttaaatgacacatcagatgtatttccatttatttttgtcatcttcaatttctttcaacaatatttcatagctttcagcacacacatcttttaccttcttggttgggtatttactaagttatttattctttttattgctattgtaaatgagattgttttctaaatttcctgtttttatgttgctagcgtatagaaacgcaactgttgaatgatgactttgtatcctgcaactttgctgaatttgtttattggttctaaccatgtctctgtgtggcgtcactcttaagattttctacgtatcagatcatctaatttgcaaacagatataattttacatcttcctttccaaatttgatgtattttatttctctttcttatctaattgttctggctagtacttctggtacgattttgaaaagaagtggcaaaagtgtgcattcttgtcttgtttctgatcttaagggaaaagattttcagtcttttgccattaaatgtgatattcactgtgggtttttcatatacggtttttattatgttgcggtaatttcgttctattcctagtttgttgtgtgtttttatcatgaaagtgttgaaacttgttaagcgctttttctgcagctattgagatgaccatagatttttagcctttgttctgttaatgttgtgtatcacactgattagttttcataaattgaaccatttttgcattccaagaataaatcctatatggctctcgtgtataatcctttcaatatactgttgagttcagtttgctagtattttaatgagttattttgcttctatatttatcagcggtattgttctgtacttttctcctagtgtcttttattgactttgatatcaggatactgatgccccttgtagaatgagcttggaagtgttctcttctctttaatttttctgaagaatttgagaaggattggtgttaattcttctttaactgttcattagatttcaccagtgatgacatttggtcctgggcttttctttgttggaaggttttggactactgattcaatctccttactagtttcggcctactcagattttctatttcttcaagattcaatattggtagattgcatgtttcaaggaatttgttcatttttttctaggttaacatacagttgtttacagcagtgtcttataatcatttgcattctttttggataccagttgtaatgtctcctctttcatttctgattttacttatttgaattttcctttttttttttttttttttacttaatctacctaaagatttgtcaattttattgatttgtttttaaaaaaactcttagctttgttgatttttctattgttttctatttcaattttggcttttttctgatctaatcttaatatttccttccctctgctaactttgggcttagtttgtccttctttttctaagtctttgaggaagaaaatggcaaggacatgactttctttagcagttggaaggacaatgctgtaaatactcaaaaattaattatttttatagtgacaaaaacaaaataaaaaacacttcaaagcaaatgaaagtttatcatttaatttatcaaatcactaagcagactgcttgatcagagagaagatactcatatgatcacataaaactgaaagattaagaggtaaggacattcatgttatcattacatctaactttcttatttccaagatggagaaactgagggttggagaaaaagaaagatttctttgttagatacaaacagacaggactaaactcagtatagcagcctcctaaattccaaagtatcatgatactgtgattttatgcattcttcagaaaaatagtagagccactggattctggcaaagaagttatataaaatgtcaagttcttcctttgcctcagaaatgaagttttatgttccaaaattgattgggaagttctccttatacctcacatcacgtctactattttacattgtttacttttgaagaatttttttaattgacaaataataattgtacatattcatggagaacctagtgatgtttttatatatgtaatgtatagtgatcagatcagggtaattagcatatccattatctcaaacattggtcatttatttgtgttgggaacattcaacgttctccttctagccatttgaaacttctatattattgctaactatagtcaccattcagtcgtatagagcactagaacttatttctcctatctagctataatttatttttaaatatgctttttgaatctgttactataaattgaatgtcacatcgttttgaaaatattcttaatttatgctcaacaggcaagattacacacctgtgataatatctttaatttaaaacattactctgtttaatttaccagaatatggaaccctagtcattttagaggtggagcaaatttcagtgataatctagtgcaaatttctcatcttatgaatgaggagattgagtctgatataagggacgagattttcgtcaatgagcagcttgttaacattagctctgtgatagaacacaggcacttgtcctcccaggccggtgtttcttctactctatgatgggctgttttgttgtagtttttaaacagcagcattttcaccatgcatagttttcttccaaagttcgttcttaacgtttttgcacagaataactagattttggaagtagaaaaaggaaattctctttgcatccttgtatctctggttattttctttgtcctttgatctctctctcctcccctcccctcccctcccctccccttcccttccctcccctctccttcccttcccttcccttccctcccctctctcacacattagagaaagagttaaggtattaaagaatacataatactattaaatttccttcacatagagaaaggaatgaaaaaaagtgaaaaatggtcctcaccaaatgtccaaacttctgtaggtcatttccatagtatcagcaatgtcctgtatggtgcctcggggatatgtaagcaaatgagcaagtggttagctaattctagctttggcaaacacttgttatggcttacttgaggagaagtcacttctccaaagtgaaaataatgtgcacaggtcaattagaatttttttgtagaaaaggaaaatactttgtagggacatggatgaatctggaaaccatcgttctcagcaaactattgcaaggacaaaaaaccaaacaccgcatgttctcactcataggtgggaattgaacaatgagaacacatggacacaggaaggggaacatcacacaccggggcctgttgtggggtggggggagggtggagggatagcattaggagatatacttaatgctaaatgaccagttaatgggtgcaggacaccaacatggcacatgtatacatatgtaacaaacctgcacgttgtgcacatgtaccctaaaacttaaagtataataaaaaaaaaaaagaagaaaatacctccttatgctcctgacttattttctttttggttcctcagtcctcttctctctctctctctctctctctctctctctctctctctctctctctcacacacacacacacacataccccacatatacaatatgattaaggatatatgtgaataatgaaagcttcttgtgtatagatttagaagtctaatggacaaaatcaatattttcctatgtgcatttaattcccccctttgatttaggtatatagtctttttttaaaaaagagaaaaaaaattaggtgaccttaaggtatagatcctactttcaaaaggtttacagaactagggagaggaacatggacaagatttaaagaactattttaagcagaataaaatgtgatttatgaacaaagcatatattatttgtgcgtatgtgtgtgtgccaacaaagatgcaattaggagattgcacagggagatgtcattagaaccaaccttaacgggtgagaagtctttgaagacatttagaacatggaagatctctgacagagggaacaaaggcatagtgacaaaagtcaagggcatatttaggactggagagtggtatgtgtggcttgagagtgggcgagaaaaaacaacaatgcctctgtaataggaaagtagacagaggcatgacattaagagctttgccagctgtgctaaaagtagtgaacaagagctaacaaagtgaagaaatgtaccttttctgatgtgtatcattcccttattcatatacttcttgagggggaaattcattctgtgttgatctagtaaactactacaggaccaaatgataaaaagaagtataggaaagaatgtttcagcatactttacgagataacttccttgtagctattctccatagtattttgagcatcacaaagcaatgagctgaaactgtctaagccaaaattgacttgtcatctgttagggatgcttagatgagaattctacatttgagagcttcttagattcattgaccactatgtcccattctaagatccatgaatgcgtgacctaactattacaccttcttttagtctgattgtcaattttgtattttcaattgtgcaagtttctaaaactattttaggaagataaatctagcagtggtgtgggaatagacaagagagaaggggaaagactcttcaggaaactaaactcacaatttatgagtattctttattgcccaagtcttcccaaagtctttcatcaagaaagaggcattgcaactctccttttatagtttgtttttattctggagcagtgatgttttggtggagttgttcctcagtgcgtaattaaagggcctatgacaattacagttcatctcctgctgctcaaggtactgcagatatttggatctactactctcattcatttccaattaatgtcagctttagatttccttcagtatgctatgttataaaatttgattatcgttgtgcccaccttcccacttaatttcaagcaggtttctcgattacctgactaaactaatgaaatctgactaacccaatatctgtggacagtagtgtgatgttactgatttttgtatgattagtcaagtcatattcatgccacgttttcatatagtaccataaaggatattcttctcgtggtccttttcttttattctgaacatacaatgagaagaccggtaaagtgggctaggaaattaaagaaaaatacaaatggcaaaaaatatgggtcactcgaagtctagaatagagagcacaatcaattttgaattaaggggtgataaggtgatttggtcaggtgactggtgaaacaggaaagaaactatactttttgaagtgtttcatccatgtgttaagattcatttggggtcaagaatctaaatttcatatccctgggagtggaaactaagtaaaaaaaaaaattatggaccttggtttaatagctagaggagcaagagtgtatctttatgtgacttaacttctatgtgaaaagtgaaccttaagattaattattgggggaatttacttactcaggttctatgcctagatggtctgcccaactaagaaaacttattttcctgttactccatcctatttttcatacttttatactgcacttgcagaaaagcatatatttctacccaatacgaaaattcctgggaacatatttttctacatttcccaaattacttcaaaaagtaaacttaggttatttcatgatctccattacaatggacaggtggccttattgaatgttgtcctgtgaatacaaagatccagagtttaaagaacaaggtgtacttgcatctcccacttagggtttgcttgtggtggagagagaatctagtttgcttaaaaggatgacagtgcagtgccccaaaatatctgatatcattaaaagtctcatatttgtctttcgtaacttctctagggctgtcgatgacaggagacccttaactcctatgccttgattatgtgaataagcacatgaaaatattttagttatcttagttcacttttaaactaagtttcaattatcactagattctaaatatcatcattgagccgttcttaaggaactgattttctacatattcattcacttcacctatatctagtgtgtctactatttgccaagaaaaatttactctcttaattcagcattccatatacttaacatcataaaaagtaggccatttttagttttctaaattatttatttaaacatttctttaaaattacattctatcattacactatatttcaacactacagtaagcagcctattttgtgatttttccttatataaaatacataattgaaattaaaaatgaagttaccaagagccattttcactctggggaatgcacatttataaattatggggttattttttcttcatcagctttcatattattaaactttgtctcttcataattacagagatgactagacacagaagggaatttaacatttggtgtgcatttgtctaacctatactttatgttagaaaatacatttccatttgaaaaaaaatcagtaattgtgggtgtgatcaagagggcagcctgaaagtcgggtgatgtgactcacacctgtaatcccagcatttttggaggccaaggtgggattatcgattgagcccaggagttcaaaaccagcctgggcaacacagtgagagcctgtctctattagggggaaaaaaaaaaaaagaggaagttagcctgaggcaatgtaaatgaaatacatatttcaaggatatttatacatgattcacgttattcatataaagatgtgccagagaagactataggtacgttattttacactattttgctaggattttaagaaattcaatgtgtttttatttcagttaacttagaaaacttacctaacttatacttctcatggacacaaaagtttttaaagataggatcaaaaagcccacatggtgaagcattttgaactggatgaaaaacatctattatctttaaaattttatgatattactgattgtaatagactccctttttaagaaatcattccttatagaacataaggtttacatttacaatcaacaatttctatccttactacaataaaggcacatataaaaagtacagttgcatatttagcaggtttaattgtacattttaatgtagaaatcaattcaattctttcatttatcagcattattacagtgatttcaaattaagcataggtaactttgatatagataaatgatgtacacagcagttaaattttattttcaattatgtagtaattgtataacctaggcagtataatttgtaaactttgtattttattattatgcttctcccacttggcataagcacaacacttcctaaaagcataattttctatagacttaataactccctaaaaacctgttttggacccctatactatttgatataggcagaaaaaaaacataatccatgctcaaatttgaaaaatgactggtcacatttggtataatactaaaggtaaataaaatcaagagtctatgaacatttccggacctgcacatttgttttattaaaatgcataattgtctttagtgtgtttctatttgtttatactctactgattttaattaaaaataccaaaatacgtttattaaaaaactgtcagaatctaagttgttaaatatacttaactaggaaagtaactgtttaaacgagataatttatagagaaatgtggtgtattgccaattagatgtcaagatacaatacaactgataatgaaaaagtagcattttcttagggatggaatacagtgtaaggaacaccccagtaagaatacaaaaattactgaaaaaaaatcttccttcctgaaaaaccaagtgcccttcaagtgcagaacctcatccaactaattgttaggtatcactaaagcctgataccttcaattttctggatcattcaagctgtatttttgagtccttatactagaggaggtaaagagctataaaaacacttaatggtatctgatgtgaactgtggatcactttgacccatcacttctacgtctacatcttggataaattcccattgttgtcatagattgtacaggtttaatggtgcgtttgtggagggggctcgcttatagaaaatggagactctgaagggataaggaataaatgtatcacttcaggtcttttatttgaaattggggtccagagagcctttttgtatcagacttgtcaaaccatttccatttagtaattatatatgcactagcacttattcctacttacctcacctctttatgcccatttccttgtagttgcggttatgcatgaataatttattgcaccccttaccaacaatggaataaaacttccattctgaaagctttccatactcatttccaatagcaatagggtttttttaacggacgtattacaaatgtacgagtcagttgaacatagtattcctctttgtaagaactccaagtggatgcatgctgttgtctcaaatctcaattagaccttgctttgaggtcccttcattgccagtcatctgttctccttcccctgacttgagtatttctccagatatagataatacattttcccaactctgtgttccaagaactgacagtggctttcattcattttgtttgtttgtttgtttcttctcgttctcaagtatcccgcagtctactgtttcttccctccattcgtttgtcctttcagagtttcaaaatccagcataggtacttcttctaaaatgtcttacccttcacatacacacaccacttgagaccccatcagcctctgtccacacagtttggttacattcatagactatttttatacatcaaaatatttgaaaattttagggtaaatctcagtagtcattcatttttgctcttattcaaccaatactagtcaatcagcctgtgccaggttttgttgcaggtaccaggtatccatccataaagaaaacaacgtccctttgttgtggaatttacattttagcaggggaggcaaagaacccaataaatatgataaaatatcagattaaaagtacgatgaaaaaaatcatcagggtaaaggaaaaagggaagcagtattttagcaagagtggtgaagagaggaggctgagagtgtgacatctgagcagagacctaaatcaagtcaaggaatgaaacatgctactatctaaagaaatgagtcaggataaggaactagtaagagccgaggcccagagatgtgaatatgctgttccaggaacagcaaagagactggttgatatgatgtgaaaaatgagaagaaaccttatgatatgtgtcaagagaaaaaaaaaatttaaaagcatgcttgggaacggaggcctccagatgaaaaaaaaaaacacagttcaaatccttgttcatgcatttagtttgctttgcaatcttgggcaaaatgttaaatttctgtacgttttatcttcctcatttttaaaataggcacaaggacatctacttaataggttcattgtgaggagtaaatgagatgatatatctaggatgcctggcattatatcatacacttaataatacactgaataaataatagttatgtctatttatttccttatcgtttttattattatttcaatgcacagacctgttcataagataatgataaatattagtggcagaaactgaagatgttataaattattaggaggcgggaccactcagttcaatgtatctgttttaatatagtcagcaaaagtgtgaagataccaacaattaaatttcaatgcattcttccatttcactagttttataaactgatgaactaccagaatgtcaatgtatgaattgcatactcattcttaacaaacagatttgcaaaattatgtgtaaaattagccctcagccttccaatttgttattgtcatatttcatggaaatacataatctgtaaatttttgttttaatgatatgtgaaactgcctaaagtagagtcttggcaactacttcacatttgtcctccagagatagtggataaaagtgtcaataaatgaacactctatattcactaatcacaggcaagggacaaggaacagagtggtcacaaaataccacaaaattaaagcacattccaaattaaatatatatgtttttattacagataatgtttgctagactctttctaattatctgcaaagattttaggaatgttttaatgttttaatatttacacacctgtgtatttcaagttcagtcaaacactattgttaaaactaaatcttctcatctctaataataagatgtgaacttatcttggaaggtggttattaggatgggagagataatgtatttcattcaaagtaaaaatatttctctgtttctatctttctctttctctgtcatctatttatcatctatatccaggtatctatgcacctatgtagactagcattcaatgaaccatagatattattagtagtagaattgttactaatattaaaataagaagtatttaagaagaaacatgtcctaaagcataaggtcaattattactctcatgttttttggcatatgaagcctaaaaagtgtcaatttcaagagagtattaataaagattgtgataactgaaaggttcctgcttgaaattttgtgtggtcttacaaatatataaactctaagcatttcagtgagccaattactgactaggcactatgtcttatgactcttttgtcatagtatgtaaaaaacaaagagtagagacatcataaaaattatagtagatgggcactagggaattacgcaaaataatttgtagatttaatgtgaaaccaaaacatctgttcaagtcaatttcccacaggtcatgtggcaaagagtatgagttccagactgaggagaggaaaaggttgttcttccacagggaaataaactgagtgtaataaacataatttttcttcttaagcattatttaaaacaaaaaaaatgccattaaatctatctttcctgcctctcttatcaatgctcccttccctttcaccacttgtttcaaactccaagccttgggattttattttggctttttgccttaatgtaactaaaatgagagcatcacaaatatgaagctcatcaaataatttagcagcattttcccctgtttttaactttctctttggaaacgtagatttcgaaatttaagggcccaaaatatgaaatgcaattataataggccatttgttcattcagcttgataaacttgaataaatagtattgaacttttaatgcaaaaagaacaaaacaaaatagaactctccacgaagaaacttttcaatgtttgcatttctgtgtgaggagaagggtaatgaatgtgggaaccttaatggaatccatgttcttccagtgatgacaagggtcaaaatggagaaaaatggtcactttctacccagtacattatattagttctatgtggacaactataacatagctgatgctggttttcaggccataaatgtaggtatgtattttcctactatttataaggcaaaatttctatttgtttaatgatttctatataggtagattattctgtctttaggattaaaaacgacctgtagaccaagagactttctaatgtccaccttagagtatatggcttttactgttacagtttccatttcctttgcttgcccctttgagagaaggaaaggagacatttgggatacatacatcaatgaggagctattaatgaataaatgaatgaaattgtcagtcaatttatccacatgatcatcaattgccaataattttatcacctctgtgggattaagtagaggtaacagtttagaaatttgattttttgaaagcatttaaaatgttcaaatatatcactctggtaactaagggaaagtgtattattttcttatgcttagtcttattttggttttgcctttttaatttaaattgaacacttatatcaaagagcttgcaggattataatttgaatttttgaagcaaagatcattttcttaacatcaaacaaagagtagatacaataggaataaaatcggcagaaaaacaagagtatcaaggacagacggggagggtgggtctgtgttagcatgtattgctatgaagaaatagccgagactgggtaatgtatttttaaaaagagctttaatcgattcatgattctgcaggttgtacaggaagcaggacaccagcatctactcagcttctggggaggcctccgggagcttttactcatagtggaagatgaaacaggagtaagcatgtcacatggccagagcagaagccagggggaggttgccacacatttaaaaaaaaaaaaaacaaaacagatcgctcaagaactcagctgctatcatgaggacagcatcaagctgtgagggatccacctccgtgactcaaacatctcacaccaggccccaagtccaacacttggcattatatttcaacaagaaaaaaagtttaattggctgatggttctgcaggctgtacaggaagtgtggcacaggcatttgcttggctcctggggaggcctcagggagtttttgctcatggcagaaggtgatgcccacacactttaaaaaaaaaccagatctcatgaaaactcactcactacactgaggacaatacaaaaccatgagggatctgtccccatgacccaaaaacctcccgccaggccccaccaccaacattgggaattatatttccacttgagatttgagtggcggcaaatatccaaactatatcagggctcatgtccagttatatgtcaacatgcctgcattcgaaacatcctgtccaaatcactgccttgtcataatacttatatttttctttattgaatacgaacacaagaagattaaataatagcatttctactttaaaacagtgggcaccatattaacattggaataatagtagtaataacgatagtaataacaatgatataggctgggtgcggaggctcacgcctgtaatcccagcactttgggaggccaaggcgggcggatcatgatgtcaggagatcgagaccatcctggctaacacagtgaaaccccgtctctactaaaaatacaaaaaaattagctgggcatggtggcaggcacctgtagtctcagctacttgggaggctgaggcaggagaatggcgtgaacctgggatgcagagcttgcagtgagccgagatcgtgccactgcactccaacctgggcgacagagcgagacttcatctcaaaaaaaaaattaaataaataaataaataaataataacgataaaaggatatgtgtaggttttttttttaataggctgttaacattaataggcattgtgatttcagggatatcatcaaacatcctggtcctaagacatcccctattgaataggaagggcttaagttaaacttctcatgagccacaattttctgattatatgtttggtgtgtgtaatagccacctcagtgatgatttgattagcctggacccttacataatcattgaagtatacccatgttcctttatatacttctttagtgttgaaagctcaaaattaagcaaaatagtccccttgataatgtttagattcttaacatttgctttctaaagctggcaaatactctcttcccagtgtcatgaagttaaataacatgttgcttagtgaggactttaatgttgccatgccataggaagaccttattcgaaatccccttacctgggagaatgtcagattattaccccccaacttgtttaacacttttaggattttaaaggtgttcacatttgtattagaacaaaatactattgagaaacatttctagaaaaaaattatctttccaaattaaaatcagtggtatgtaatgtaggagtctgattataatgattaaaatacatgggctttgggcatactgcctaggtgaaactcctggtttattgcatcactattagtataacctatgggagttaacctacgtaagcctcagttaatttttctctcaaattgatctaataatcgtctctcataggcttgttttgatagatatttcagtgtatataatatacttaggacagtgcctgatatcagtaagtctccttatatgctatttttctttctattttaattatttatgcaagagaaactattatgctttaactcaattaaaataaaatgcctttgtatttattcatgtcaaaggaaatatgcaagtattgcattcacttcctaggtgcctttttgaattgagctttgcatggttagtttgtataaaaggttcagtgaactttctcataatgattttttattgaacatatggaatccattaagtgttagcaaaagtcactatccactgagctgtgtccaggggctgacagttatgtctatctcttgcaaaaataaacacatacataaatgcactaagacgtatattacctgtcgtcatctcttagagcatttccatttttcttttaagttttttctttcaatgggttttttatctttgtgagtacatggtaggtgtatatgtcaacggggtacatgaggaaggtgtatatattgatggggtacaagagaggttttaacacaagcattcaatatgaaatagtcacatcatggagaatgggttatctatcccttcaagcatttgtgctttgtattacaaacattctaattatactctgttagttattttaaaatgtaccattaagttattactgactatagcaaccctattgtgctatgaaacagtagatcttattcttatttttctaacatcttagaacatttccacaaacactacctgcttgttaaatatacctattctaatcttcatataatcaattacttttttcctctagaatgtactatgacacatccatggggaaaatgtagtaatctaattaagactatttcctctcattttatatttaaaagaatgtgctctatcaatttatttacttgtacagccgtaggcaacctctaaaatatttaaagttcttaaaagtcagatatttcagttaatattgtgattatatagttgattttgatgaacatgttcatctaccagaaataaattatacacacacattgatatggttaggctttctgtccccactcaaatctcattttgaattataatccccgtgtgtcaagggagagaccaggtggaggcaattggatcttgagggtggttttgcccatgctgttctcctgatagtgaatcatgagatcagatggttttataaagggctcttcccccttccctcctcactcattctccttcttgccaccttgtaaaggaggtgccttgctttctactatgccctttctactatgcccttcaccttctactatgattgtaagtttcctgaggtctccccagccatgctgaactatgagtcaattaaatccctttcctttataaattacccagtctcaggcagttctttattgcacatatatgtgtgtgtatgtgtatgtgtgtgtgtgtgtatatgtatgtatatatgtatacatatgtgtgtatatgtatgtatatatgtatgtatatatgtatacatatgtgtgtatatgtatgtatatatgtatacatatgtgtgtgtgtatatatgtgtacatatatatatatatatatatatatatatatatatatatatgaacagagagagagagagagagggaggaagggagagagggagggaagcatggagaaagagagagtaatagcctaaatagaaataaaactagctccaagtacaggttcgtcaacactctcctatcatacccccaccaaagttaatgttaaccacttggagccctgttcttccttagttgtggagtactttagcaaaattttaaatctaattatgcctaattcaacgacagtgctaatttgaaagtgttagaaactgaagacctataataataatgagagttacaaaacataaatagtgagacaatgatgaatgtagtggatgcatgtacgagggctatcatttgacagtagagatgatgctcaaggacagacaatgagtctttcaatgtgtggagaatgtgctgctgttacagtgatgtacaggaaagaaacaaaaactgaggaagtatcagtaaacaaaacactcaaacatatgagtatacagctagaataaaagcaacagtactagatgacaataagcccaatgttaactcagaaagcagaaggtttttaagaatttggggaatactgtggctgatgatacttatgtctcaagccacagatgccatatgggctctgcgcccagttgaatcggcaccacctggcagtaagtgggcaggtccacgactgccaggacatcccttccaacacttgtggagatcaccaggaaggggggagagacctgccttgacagattttcaatgtgggcgaaacaggtctattttgagaaaagatgttcaatagaacatatgtcagcaaggaagaagagatgatgcttagttctaaagctccaaagagctggcttacactccaacttggggaaaatgcatccgggaaatgcaagattaatctcatcttagccattcttttgaatggatggacatgacccctttctacttgaagacagaaaacataaccatattgatttcaggttttcttcattggtttccatttaggattgttcctccccatcttctttctgtgtaggcatcccagttcccaagtgttcatgaagcacgtatggccttcaggggatgtgtctgtatacattgttatcttatggatgcacggttttgtctgcaccttggttctgaatgtctttactcttgagcatctgcccatgggtccccttctcaaggcctcaatttcttgagtttaacactgcatggcccatgcagcttttcagttaagcatctcttgctatgaccaactcttttcctcagtcaactcccacactcttttcagggacaggaaaaatgtagccacttgctggctgcactctgaggcctcaagaaatttagtgaatctgcctttgcccttcttgctgatgaaatactgccacatcaggccccctcttcggaaacctacaagcatctaattttcttgcttcctccccaactttctttttgactcccccccatccagagagttcttatgtctactgtactaggaaaaactcattcttaaggtatggttttcaaatcattctctggtctggactttagctacggttttaaatgaagaaacaacccagagccaaaatataatgaaactatttccttcttccacagagtggaaactgctttggggttaaagggccagtgaaccaaatagaaaaggatctcagggaacacagattgaagagagagaagaaaaaatatgaaggcattgttggttctcttttgagtttaaaatctagtggggattgtaagcacacacacatatacacacacacgcttacacacacacaccagtgaagttatgaaggattttgtcactccaacgaccttgaatttgattatctaggtcagttgttaccaaagtggaatgtacatgcccaataatatgcgtgctaaacagttggggtagtgagaaaaaatactttttatttatcttgttctctagaaattaatattttgattgtatattttatagtgtatgtgatgtgtaagttgtgtctacaaaactagtgtcaatgtaatttaaaattacatatgtctgtgaatatatatttatatagggtacatgcttaaaatgtgtttacttctgaggtacatgaacatttttcccccaggcacagaaagacaaataccacatgatgtcacttaaatgtgcaatgtaagaaaagttgaattcatagagatgtagagtagaatcatggttaacagaggcttgggaggtggagtgagggaatagagagttactgttcaaagattacaaagtttcaactagacagagggaatacattttgagatctatttcaggaacattttgagaccctcactctaagtaataggaaatcattactttagttaacatatttgaatatgagttgtgatgttctatatcgtttatttggattctactaacccacacctagatttttatggcattacctttttactcactgtgaatatcctactcatagacagatgccctgggaacttggacttgaggcacccaagaactgagacagtgagatttgggggcacaaggatctatggataagttcatcttagtgatgataaaatcaatttggcatgtttcacggacagtgtgcattttagaaagggtaaagacttggaaacgggatatttttgagcccaagtgtttccaataaatagctgtataatttgaagcaaataattgattttttgttctctttgtgccctcgcctgtaaaatgggagaaatgtattcctttctcatccttctcatgaggccattgagagtatctaatgagatcagactgtgacatagcataataattctcatttcttgaaggcctattatacactttgcaagcactgtatgtgttgtttctacttctcttgttcgtttttcctggaataaatatccccccctcctttacattggattgccattattcaccctgtaaggaaggcttcatggttctcattttcatctgagaaaacttaggctcagagaagatcagtaacttatctaaaacacacacatacacacacagacatatctatgcccattattcttaacctagtttctctattcaggagttatctctgctgtctctgcttctgattataatctgtgtaagctgatccaagtgacacgattacagggaaattgtaagccctttgagagcagagactacctattgatatctacattttaaaatttgattttagccaacctgtttatatgcaatgactaacaggttagtttgacttgcaataaatattccaaatcctagactaagtaaatttattaatgtaatgatttaacttgattttttcattggcatgtttccctgaagtcgtcatgcaaaattgaaaaaaaaaaaagtatagtgtgtgattctagattgaaattcaggaatcctccagggttaccttgtttgctttccaaatagttcagattgcttagtctgaccaacaaggtccctgacacttggaactctgtctatccctctaattgactttgtccctgatgacctcgcccagagatactcttcaccccagctatactgtgttgctagagtttctctgatatcccatgctattgtttcctttgttctcttcataaggtaccatttcccacccgccaactcctgttttcctgatggacttttgtttcaccttacaagatcattgctaatgtatttattttgagaataaaaagtgtaggaaaggtcacgggacaaagctgtacaccagacctttcccagacgaacctagtgtataatctccctagtccaacatcatggcttaaggcagtcgatagatccgtcttaatgtcccttttgagttttctactattattatatgaggatttatttttgtctgaattcctccctagatttgccctagagagcaatgactatttacagtttattcctctttgtatctcttatgttaaggccagaccttggcacatattctagctgattagaagacgtttgttgaatgaccaagtgattgaacaaatgaccatgtgctctgccacagtccggtcagttctactttggtttggttatgtgtttgccacattaaagttgtagcctgggaagttcagttgtgagatgtctgcagaacatgaaaaattggaataatgaggttatttctaaaattgctataatttaaaataaatagtggtttattccatatatgaatatacactggaaacaaagaatttctagaatactggagattcaatgataacatcattgaaattaaataaataataggattatgctagttactttctaatttactagaaattgaccgtgtgcatggcacgtataatgagtatcatgggatagttacaaaaagtggtgcttagtgagtttctgtggaaaatctcggtaccaataaaacggaggatttccagaaatcgatattcctcaaagcttgacagtatttatgcacggttacactttgtgtgtctttcgtttgaatcaatggaaggaggctataactgaaaattattgttttagtgtattatatctttaataataagagttttaagaatctatcattagaaataattattcctcaatttgtaattctcaacatttgaacaaataaatgctctgtgtctatcagttaatcttgcccatgaagatttaataaagcacgctagtttttacaaatgtgattttagagatggtcattacttggtaaaatattttgtgttaacacttccatgaatatgttctgtgggaatatactgcctccacattgcttgctcatgaagacatgatttttcacatcatcctatcagtattttgagaaagagattgatcccatattctatgagcatttgaacattctctagtatttttgtttaatcattaaaacaacccttgaagtctatgtgctacactggttatttccctcttgactttcctttacagataaccctctatcataaacaacctatctatatttgttgtctccacatcatgttgccagccctgctttaacacactgcacattgacttctagcagcaaaggctcatgggaggtactctcatcaaggacactgatggtcctcatgttgctaaatttggtgggtcctctacagtctttatcctagttcaccttattatggaccactgtcaactctgttctgcttaaaacactctgttccttgcttatatgactctacactcttaactcctttgtgaattcctcatctgcccttccattaagtattgacgacatccttcatagttttgatctaggacctcttttcctcttacttgacattatgtgggtaatcttgtctttgaacgcaattaccattcttatgttgatgacccttaagctataattccagcccaaatcatttttctgaggaagctacaagaatacacaaatgtctaatagatctctatttagatgtccctcaggtgcttcaagcttaaaatactcacctgagctcatcacctcatctataaattctgcttctcctccctggctccctgatttatttaatatgaccaccatccacttagttgaataaagcagaagcctggacaccatctatacctccaattaatcactaagttttgttgttaaatacgttcttacattttctctctagaatgtcttattttccccatctttacacccaaaaccaaaagtcagatgaccctgatctcctgcttagatttcaaaacactatctcttgcctagactctggaatttcagtcttgctcctctccaatctatttctacaccctagactctggaatttcagtcttgctcctctccaatctatttctacacaaaagctagagtaattttttaaaaaacaaaaatctgaatgtgttcattttctgcctaaaagccttcagtaattcttatttgttcttccagggatagagtaacaactttcagacctagtttattagctagttctttaaccacaaaggactctctcacttgtctactccccctaacacacttcgccctaacctttgccattcctccctttcccttttccttcccagatggacttaagtcctttcagattcttaaatgtttcttcctccagtctcttacatctcttttccttgtaactctaaaaactacttagcttacgcaaggaaaaaggtctgtacaattcccggaatcagcgatcctaacgttccctgttgtttttttcgttgggacatgaattcattcacagtggctctaaacatcaccacccctgcctatctctcccattcctactttatctgagcttatccatactcttgaagacttacatattttttttctaccaggaaatcattactagccttattatcccactgtccaaaccaataagtctgattaggtatctgtatatatttaatattactatatgtgtttttctaacactctagtagaggagaaggtgtatttctttctgttttttagaagcctgtatttctgctattatagctcttaaggaactctcatgcaattgcctactagaatgtaagttacggtaggataagaactggatcagtcatatcacacatccacatataggacctagcaccatatctaacacacagcaggtactcaatacatttctttcccaaataactaaagagtttaaacaaaccaaaatgattaaatgagaagtaactgttttggtaattcttgtgtccttactagagtctaaattgagtgatttttatatcatcagtttatactcccctttcccaaccccaattctttcttttttaaattttttaaatcaaatatgccttaaaacttcaggatcagttgagtaaaatgatgcttttgtcgtcttttgcaaaataattgtatttcagaattttgatttagatattataaacacacctaaaataatagctttagtcttaagatgaagtgcttcttaaactccctaagatgggttggactatggatatgaacatggacaatatcacattaatttgtgtacacagttctaacacagggtctggcatataagaacaagtcagtaaatagttgttgaatggaattgaaaatttaagtagcaaataaagtattttgacctacaaagcaagaaatcacatttttctttttgtcacagttccttaggaagataattaattttttagtatttaaggatgttaaatatttattttatgttctatttactaggcttctttttatgaaaattaattggtgaaaatagcgtacatatcttcctttaccagaacatttacattttgggcagtaacgctggcttttgttaaaaaagcaaaatatgtgtgaaatttatgtttgagttgatttcaatgcattacatttccattttaaatcttctttgaaatactctatttttgacaccatgaaactgtattagatcttagtatgttagcaatgttttgcagttttagagccataattattttaatgaccactttcagcatatacgttttctacaggaaaaataatctcaagaacatgaaaagtgaaatctatattttgggtttcaaaatgatacattttagctaaaatatcatagttttaatttctcagtgaaaaatatagtgtggtaatttatgaagagactcagtgtttaaaaattatgactctatagtcaagtttatgtttataggacataggttattcaattacatttaaaataattaatttagaaaatgtgatcaatgtaacaaattttacctgttcttttctaaagctaaatttgttgtttgaagtgtttcttctaaaatgctaatgaactatcaatttaattgttgagcttagagttagaaacttaattatattgccagaaataaagaaacaaatggatcccaaaagattcacacattagaaatgtatgccagggaaatgcttttgaatgtgttcaagtcatggcttctaactcgtaacttataacttgtgttatgtctggcttcattcccttaagaaaaaggaataataatgccttcggagagcatcccagctgtaagagctatgcattggtgtctaaaaaagcttctcactcctcataccatcctggtctgggaatttaaaaaattgtcatcttttgataatctgtatcacatagtcttctgcatagtcatatgaggttagaactgccccataacttttgcagggcctatagtaagtgtgcaaatggttgcctgcatgccacatatttaatatttataaggtataaagtcaacagactattaaatatatcctatctgctttccttgacaattatacaatcataatgatatggacatctagattcgatttagaattctctctctctcattttctttttcttctttctttctttctctttctttctttccttcctttctttctttctttcttctttctttctttctttctttctttctttctttctttctttctttctttctgtctgtctgtctgtcttgtttttttaaatagtgcaagcagtttattccctggcaaggaatttggaaaaaactcaaatagcaaaccacttgatacaataaaataaattccttagagttttgtactggaatgaggcagcttggttagagctaaccctaagcctgttatttaggatacattggcttttcttaagcttaaaaaaaattttactgtgttaatgacatttaacatgagatctatcatcttaataaatactacatgcacaatacattattattgactctaggtagaatgttggacagcagatctctagagctaattcatcctacttaactgaaatgtaatgtctgttgattagtaacttcctatttcgccctatccccagcccctggcaaccaccagtccagtctttgattttatgagtttgactgttttagataccttatttcaagtaagtggaatcatgcagtatttgtctgtgtctgtcttgtttcacttagcgtaatcttaaggtccatccatattgtttcatattgcagaatttccttttataaaggctgaatagtattccattgtgtatatataccacatttatctattcatctgccaatgggcatttaggttgtttctgcatcttagctattgtgaatctgttgccttttttccctacctcctttactccatcctgcactgtgaggaactctgtgcacatagatctggtcgccccatttcccacccacatgttcaagtttttcccactcacctcatgcaaagatttaccccttagccatacccagtaactgactttgaaacatttgcccagggagttgagggattctgaatgccagatcatgggagcggggcttctagtgagcatgttggcttggtcctacagactcctaatcagagctttgcctttgaaagcatggggcccaagggcaaggaccctacttgttaaggtctaaattttttttctgaaataaccacatcgagcttttatgtgtagatggcctaaattgggctaacccagaggcagtgacactcaagtagtttacatctaagcgctttccatgtgcttcttttcccatttctgttacttcttacaaaataaaaaatcagcatctcaattaccctgatttgatcattgagcaatctaaaaagtatcaaaatatcacatgtagcccccatatacatacaactgttatatatcactataaataaatatatacacattatatttaaaaatcaatactttaattttacatgtttaacaaatcactagcatatacattccagattgaacttacgagggatgtggaaaagattcagtgactaaataacaataaagtactctaaaaatgaaaatgtgaaatggagacagtataaatctaaaatcatatcacttatgaagtattgtttcaaataaacaataaaatatatcttcaatcaatttaattttattttagttgtataaaatctttcggtcagcattaacctaattggaacactaaataggtacatctaaaaaatataatcccccccaaaaatatgtagctcataagagataatgcattgaacacagataatattggcgttaaaaacagaactctaccacatttgcaacgaaatgtttatctgttcttcctactagaaaataataaaatagttctgcatgagcttgaactcgaagtattaggtgtacaaagaccttttagtgaatgaatgctagctgaaaagcaaattttaaatatgaaaaattagcaagacaaacatttgaatttgtgggagatgagtaaaactcctataaaaatgaattgtttagtgttaaacagattgtgtatgaaatattaatggcatattgtcctgagctccccttccgctgtttccatgtagatgactgaatttcaaacagaaatatgccaggaatgattacgtgaatgaatattactacatgagattgcttaaagagtatttcttcttttgccttctttttactttcgttatttcatttagtagttagaaaatactgtctacaaatatgtgagaactgcttaatttatttttgagacattaattaattcaactaaactatattgactgtgtgagagagattcccttggtgaatatgtggatttttgcggtggtaagaactctcctctggagcgcaaatggtattgctctaggaataaagcatatacctcaggcccagatgaaccagtgcaatctacagtaacaggttcaaagatgacctcatgacctactgtggactaataaaaatcaaggagacctactgcaaaggtttctgggaaattctttttctcttgcgttgaactaagtaatatacatatgtgatagttagagctgcagcctttgtaataccatgacagaagataacctgaaataaggctgacagacacaagagggagacctaagagtactgagagatatggagcaggaccccctgattgaacttcacttgcagcccccttctgcagttttcaatgacgtgaaccagtagaatccctttgtttactgtttttgattaatttgagtgcagctttatgttatgagcaactaatagcatcctcactgtcacaactgccctctatacggcaggcactttgtgatactaaagaaagcagtatacagagtagagcccagtgaataacagggcagatgttgcaattaaactgcctgtttaaattctagctcttccactagctaacttgtgactatctaagtaatttaaccttcctataatcatacctatcttgaagacttgttgtaagatttaaagcacaacagtgctactataaaacaggtatacagtaaagcttagctacttttttattaggccatatgatatcatttcattaaaatcttatagccatgctataaggtattatgatcctcaatttataaataagacagctcaagttttggtcaagtgactttaccaaggtcatagagctagaaaataatgattccaagttacaagccaaacctcttcaatgccaaatttacatcatcccccattacttgaagtgtaagattcacatggacagaaatttttgactgtttgatcactgctatctccttatcatctaaaacagtctctggtccatattaggtgttcaataaatatttgtagagtacataatttccttcacagactccacaatctggtgaaggaggcagacatgtaagagaattatttcaggattccacagttgatgctgtaacagagctaaatataatgaatggaggaggaatgaataagtttgtctgggagcaatgctatggctattgaaataagtcttgctcatgctttgattgaaatggtggatatagatcacacaacaaataacaattagataacagcttgttgggagaaagcgaggatcagtgtttgccataaacatttctcatagctaatgtcaggtgtttgatttctcaacattttatatctttgactttgattttctctgtttttattttttaactccattctcaagaagtctgcacataagagtttcaacatctagcacttcataactccgtcatctcctctcaggcttagagcaaattctgagacgtggatttatcgtcgagtgatttcttcctggcattttatctctgagaccaggatctggttgctaagcatgtagacatagaaatgcatttcttcattgaaccccataggttcaaactagtggataatgagcacaatgtcaatgtgattatttgtaatgggggaaaggttaccggagaatattacacgaccatccacatagactaacattttcctcatgactaagtttacttagcaaaacaaattaaaaacagaagtttgtttagcagcacagaattgaaggaagacaaccagatggttatgaggaagattcatccaaactatgccagaactgaaagaaattaagttcattcagtacaagaattgtctagaataagagaatccattttgtgtcagcacttcccaagttcttgttaatgctaccttaagttcaattcaaaccaggcagcatttattacgtgttgtgctgggtcctaggaggaccgcgttttaagaacttactgtgatcttctagatcaagtttttatttcaatatttctacctcatttctgattcttaggtgttccttatttcccaatttatcccctgcagaaattgaggcaataagatgtctatcttattgcctatggtgttgattatttatgttatattctgttttgtgaagtttgacctctacctaattaaattacattttcaattgtatcttggattgatttattcaataagtattctttaatatttttgcatgaggtcggtcaggtttcatcagacattaggaattaattataaaaatctctagattggtacttggagcttaaaggaataaggtggtggaacgttaaatgaggaggaaagaaccagcagagctgggataaaattcatctctatcatcttcccacctgcttgatctctggcatataatttactatccgtgaacctcaggtttctcttcagaaaagctgcagggttgttgggggaaataaggcaattcctgggcttcagtatgttcaaaacagagcattaatattattatagacttttgatgatttacacaattttagctttttggcaagacatatttactagtactaagtaaaagcacgttgactttctaaaatgaaaatgtgtatgtgaggatgaagaaaaagaaagtgttttgtttgataatatagcattataacactgcacaaaaaaaaaatggtatatgcagagacttccatcacttgcttatgatgccgcattgggatctcattaataagacacttcctcagacacttcctttgtgttcaataaatttcaatttcctcctttccttcagttcacttcaagaaggacggcagcaactttcttgttgccaaacctgacaaatgttttttagtgctgattatactcgagcattctgtagcaaaatgctgtgggtgaaaatgccttccttcttaagggaatttagcttctgtagtaccagaatctccttgttgaatgaacatgtactgcctaagtcttagtaatccctcctttttgagcccattttctggcatctctccctttaatattcctcaaaaagttggatttttcctggacttttcatattacagactttcctttggtcatcctcatccattccgtgattccaactacattttccctccatcctggcatcttctttcttccagacttgtatatgcaactgcttccattcatacacttgaccaaccttttaatttctataagatcaaaaactcagctcacaagctttcccctaccatcgagcggggttcttcttttgcttctttgtttcagacaatggcaccaccatactcgagtaaggcacgttcatttatcaggtcctaccaaatctacaataaactctcttgaatttatccacttgttttcatttgaacagtcatttctttacctgggtagcctgcaccttctacctgcattgattcagcagtctcttcaccactggctctccctccctctcctgcctctcttcttgctccttcaatttattctctactcttcatagtgacttttattaatgcaaatatgaccttataactcccttgcttaaagacccactcatgtttgtctttgtatccataacttccggcctagggcttaacgcatagcaggtgctcagtaaatctgtggtagatgaaagaacaagttgtataaatactgaatggtctgatgtgctctttgttgtgtcaagaaggacattttgcagtcaggatagctacatcagtcctttagtaggcatttgacagcactcgcattattcctcaagagaagatggatgtattgattctgtatttcaaatgacataacttttgtgaaataagaggctgccacggtaatctgagggatctctcaagttcaagggactccacagtgctttgtgtaaggtaacaggctaaagggttcagtcttaaactttcttaagactgtagttcagggttcctatggtggggctataaccctgaattacatcctctttcatttcatgctgataatgagaactacaaaccaaggggtattaggaaagaatccaggtttgatgcagggaaaaataaaaacaactgataatctctagtgtccccaacttcaagaattcctttcttctttacaccaagctttttttctctgccaggacttactttgtcttctacatgtttaagggagaaaaatgagttaacagaaggggaggtacagcatttctatttacttagatgctagagaacaggatgaaaggtatgaaaaatatgaaagtctctctctctctctctccccagccttcccccgcttctctctctctctctctctctctgtgtgtgtgtgtgtgtgtgcacgtgcgtgtgtgtgtgtgtcataatactcaacctttcttttctttcaagcatatgttgtggcagagacaagtgtacatcaaaattcgtggtccctctttcatagtatagagttcttgctaggatccagctgcaagccagcaactacatttcccagccccactggcatctagttagagccatgtgactagttgtgaccaattgaatgtgagtgggagttatgttgcaggcataccttttccatcttcttacttcccatttgctaaccttatggaaaagagtcccaaagacctaggagatgaaaaagcctaaaatggaaggactcagagtccctgaattactgggtagagaaaagctgtttgcagatgggaatgcccattttgtagtattctttcttttcttaagccactaaaattgtgggatctctttgttatagctactggcattaacctcttacgtatacatacagctatgtgctacaaagaggaatagatacattttttaatcgttgaaaggggagaaagaaacatatttaggaggaaaataatttagtctctacaattgaaaagtgttttatgaataatattttgttttggcagcatattaaatctcaggcagctgaactacattaattttcaattctctatatatgtttttgtcttcagggtttagtaacactgatatataacagtttctttcttttaatttccaaatttaaatgtctaagtttgccttctaggcagaaattaagtcccattgtggaatgagattggatcaacacttcaccaagatcattttagttctttgtaatcttaaatgaaataagctaataaagcattaaattagcatgttgtaaaacttcgtgaagttttaatatgcttctaagtggcagctcttagcttattatctctaaagctaaagtcaaaataaatgtctcagttgatgaaatggagatgaggcaacattttatcaaatttaacaaaatattttatatctgaattataaagtccagattatctagtaattatcatataaatgtatttaaccagacatgcatttttctctaatcagtagccctggagtctttggaccacaaatgtgccttatctcaaatgctttaactgtgacattttgctttagactagctcgactacttctacagaaattatacacttcattcacattcatccagatgaaaaaaatacatgtagaaatgatcataataagtaacatttgtttaggatttcagagtttacgaagggtttttctattcactttctcacttgttcttcatgtaaactggtttggtggacaactgtcattatccctgttacctggagcccctgggtcttagggagacttcttgacttctcaaggtcatgaaggtgctaactctgaccgtgtttttattcctactgtgccacacttctcaggtaaaaatcatattgcagacactttaagagaagtacttaagaaaataaattcctccagagaattacatttaagttgtttcattaactgcagtgcataaagaaaggaaaagtgttcccaaacccatgtagtattttgctattgcttatggtaatattctgcacacctaatattgtcagcataattttccatgtaacaaaatgtcctaaatcagcaatgtccaatataactttgtgtgatgataaaaatgttctgtctctgtgctgtccaatacaacagccactagatacacatgactactgagcaatggtaatatggccagggacactaaggaactaaatttttatttaatattaaataacgtttaaatttcaaaagccgcatgcggctagtggttgtcatcagatactgcagttatagaaaattagaatttacctctttaaatactaaacctatttttaatagtaggatttttaaattaaaatagttctaagtgcttttaagtgatacgaagtcaaatgcaagatttctgttttaatagtactctcaacccagagacaatcttcatgcatccttatacatgttctttgttgccttattctagttttattttaacattaaatgcctctgttctacttgatattgacttgcttcagagaacaccaagtatagtggaaagaaacacacacatgaggacttgaggctaccaaccaggttcaactaaatgcactctgatttaattgtagtattgggatcccctgttgcatttattgaagaagaaaaaaactttgcaaccaaaaagatatttgaaagcaactgttcttcttggacacatgatccctcataaagtggggcttcctgcttttcagagacttaatttctgttcatattcatttcagcaatagtaataatgatgatggcgatgatgataataatcatgatgatgcctaagtgttgtagtaatgcttcttctgagccagacgttagtcaaattactttctctacattaattcaggcaatcatcacaacaatcccacaggacaggttttattattatacttatttagctagcaaatgatataactaggttaagttacttgcccaaggtcatactgccaagacagtggctctagtgtccctgcttctgaccatatgttatgctgcctatcctagagcttttctcttctaaaatagtaaaataatatattctttgtttgtttcatacttttttttttttttttttttttgagagggagtttcgctctttcgcccaggctggagtgaggtggcgcaatctcagctgactgtaacctctgcccccaccaggttcgagtgattcccctgcctcagcctccgaagtacctgggataataggtgcccaccaccatgcctggctaatttttgtgttttcagtagagacagggcttcaccatgttgaccaggctggtctcgagttcctcagctctggcagtccgcccgccttggcctcccacagtgctgggattacatgcatgagccactacacccggcccatacataaatattttaagcgaagtacacatgcatgatcatcatacttttaataatttcatttaactgtttccaaagaatgttagtatgaggttttctttttttctttttataatttcaacttttattttagattcagcgggtacatgttccctggatatagtgcatgatgatgaggtttgctatatgaatgatcccaccacccaggtagcgagcatggtaaccactagttcttcaacccttgcctgttcccttcctccctccttcctctgtagtccccagtgtctattgttcctgtctttatgtccatgtgcactcaatgtttagctcccacttttaagcgagaacatgcagtactcgttgtctgttcctgcgttaacgtgcttaggatagtggcctccaattgcatccatgttgttgcacaggccatgattttgttagtttttatggctgtgtagtattccatggtgtatacgcgccacattctttatcctgtccaccattaatgggcacctaggttgattgcatgtctttgccattgtgaatagtgctgtgatgttatatgtactttttggtatattcaaagagaaatgctattttcctcttgacatatttatgtcaatttaacatatttatgtcccttttctttttaggagcaccattctcttcctttaacattataaataaaatattttttgcttttctgtttttgtaagtgcagttttattgacagagtgagacatacacgtcgatattgtgactagctgcatgtcttctattatttagaggtctcactcaaatgtagattatcaaattctgttagtgaagagggtagaacagcagaactaatgctggtttccttctctagcattatttgatgataaactaagatgataataccccccaggtcttagatacctgcagtaggacaggcaccctacatttaatgctcctaggaatccttcaaagtgatagcatagttattatacagtaattgagaaaactgatgttcataagttagaaatttttccgaagttgcaaagaaagtgaatggaagaattataccaagttctggccgggcgcagtagctcatgcctgtaatctcagcgcttcaggaggccgaggcgggcggatcatgaggtcaagagattgagaccatcctggccaacatggtgagaccccgtctttactaaaaatagtaaaattagctgggcgtggtggcacgcacctgtaatctcagctactcgggaggctgaggtaggagaatcacttgaacccgggaggcggagtttgcagtgagccgagatcgtgccattgcactccagcctgggcgacaagagcaaaactccgtctcagaagaaaaaaaaaaaaaaaaaaagaggattataccgagttctctttgattccaagcccaaacaaatccttttttgcaatatatgacattgtttccctgtttgcattccccattctgtgtatcacacatcctgtggcctgatcaaaattcattttcagattctgaatttattttccattgaatctatataaactataaagacagaagatatatgtatgtgtgtatacccacgtttctcttccagtgtcaactgataaaaatagatttcaaagtctcaataacctttaattccctttttctcttaaaaattctttagaacttgtacatgacattctgactctagcagattttagaaaacagagaggccattagatattcataccttactattcagatgaagtattcaatgctaaattatgtaatttatctgctttgcaaattgtatggtcagattgagttccacaaaggagagataatttttaatataggcattctgtagcttccctaattattgaattagtttagagcaaaatccttaaattgtatcgttgctatgctcaaattttgtatacttgtccacgtaggctatattaagatttcattgaattttggtttctttctcagtgataattcaatatatcaactcaccactcagatttgcctttgggaaaatccaggccccttttctggatttttagagcagattttaaaaaagtgattctgtatatgtgttgaaattaaccacatctcattgcttttgaatgattgaggtaatgtatacctactactttaaaaaaaatgacttacttagaaggtgtccatagttttataagttccattgaactggtttatattgtatttagaaaggaaaactactccttttatccttaagggtgaaaacctggattttattatacaattaacacatatttattttttattatgaaatatatcacaatataaacgtttacagggagtgtttaaagtggtgttgtccaatggaaatataatgtgagtcaaatacgtagttttcaattttctactagccatattagaaaaagaaacagagaaattaatgtaataggatactttatttagcctagtatatccaaatcacaattatttaaatatgtaatcaatataaaaattactaattatgtatttaacctttttctttagtaagtctctgaaatctagtgtatattttacatttatggcacattgcaatttgcattagtcacatttgaattgttcaatagccacaggtggctaatggctaccgtgttggacagcacaggtttaaagaataatatgaacatctgtgttccaacattctgagtttcaaataagaagaacaccatcagtattttgggagaagctccctatgttaccccttgctaatcaccttccttccccccagagccaaaagtaaccattatcttgaatttctagtaaacaatgctcattttttaaaaaacgtatgttcaacacctgtatttgtatctttaaagagtagctagttttagtttgcctggatttgaactttatattaagggaaccaccccatctctaatcttctctgtgaattcttttctctcaatactatgttttacatatttacgttcatcaatgtgcaactcattgtatgtatataacacaatgtatatattttacatgcgtatggacatttgggttgtttttatgtttttgttcatcacaaaccacaacacacatgtgttcttgtatatgttttatagtgcatgtttaaaaatttctcaacagtattcgctagtagtattgtcaggtcatagggtatgcacacataaatagaaatgattgattagctgcaatttgtagtgcacacatatttgctatgtaagtgatccatgtttaagactttaactgaatttaaaaaatattttattggagccaatctaaatgagctaagggtttgtattgtttacataagcaaagattacacttactgggtcaattcggttgattaactttggatatataaaatatatagctagttgttaaatagatataattattaattggcattacttttgtttgtatataaaaatttcaaaatatccatgacttaagcaaggtaaacacccactgggtggcttaagcaacagaaatgtatttcttgcagttccggaagttgaacgtctaagattaaggtgatgacagggttggtttctggtgagtcctcccccattggcttgcagatagccgccttctccttcatgacctttcctctgtgtatgtgcatcccttgtagctgttcttccttttatgaggacattagacttattggattaaggtcctacccatatgaactcatttaaccttaattacccctttaaaggccctacctccacttgcaggggttaaaacttcaacatatgaatggggttgaggagacctacttcagtccataacagtttctatattctgaagatggtctttaattaactaaacagttaatgttactttactgggaatgtcttttggatgggggaataagctgatgatatgagaagggttggtgaatttctcataagtgtgaaatttgttgggccggcccagcatgattttcaatcaaatacgctttggggacaagtaggttgaatcactacgagaggtttaaaagaaagcaagttgtaattgcaacttttaattgaaagaaagacaggctttgttgatgtgccagcaagactgataactggctttaacgtagatagtaaggcagcagattcaatccactgatcgtgatctactagtgaatttcaaagccttatgcaatagaactacaaaccctttccttgcccaccttgcaggtggatccataggcaaaatgaacatttgcaaaaaagccgctatgtttcagaatttgtgctagggctttaatatctataatttctccaaatcctcacaatttaagaattaattcaacttagccccatgaatagggtgaaaattctgagatttaacaaactaaaataagttatctgaagacagacaaatagaaagagttgagatattctatttgaatgtaaaattttcaaaaagtagaatgacagcgtcaggaattacagtctcagtgttgaacacaagacttaggaacaaatttgctgcatgtaatttcattgagatgggacaaagtacagcatacgtaaggaagttttagaacaaataagataattattttacgagctttgaaacatgtgtaagaaagatacgaataaaagtataatcacatttgactaaaacatgaataccttaaaactgaaaagcactgagattatcattatataattttgaatattttaaaccacaatgctttgggagtgcactgtaatattttagaattggaattttaacttactggcttaaaaagtaatgtactttgttttaaattcaaagattatcttgtaaattcagttcgatctattgaaaaaattataaaattcggcaagaagccaaagaagaacaattatgtagctcaagataattaaattttcatgtttggctttagaaatatattcgtcgtgacatagtacatggtaatctagtgagcccagacaagtagttttctctttttgtcaaagggaacaatttgatgcgtgttcaagttgcttaaataaaattttgtatgtgctttctcatcacaagagaacaatatgatttttgaaattatttttactttataaaagaaaaaaaaaagccctcacagagaaaaaagaaaaaaatgatgatgtctttgaaaaacaaagttaatacagctttacatatatttgacctacatcagggttaatatttttcaaggtgaaacattagatgctggaacttgcaaaaacaggcaatcctcctttagatgaaacggacactctaagggttaattcattcactgagacctattgtgaagtaagccctacagagactgaaaaagttaaatgcaactcacaaaagttgctagaagagtcatgatgttaaaataaaataagtacacaatgtatgctgcaagtatacttagagccatgctaggtgcggttgagaagttcaatacaggtccaagataatagctgcttctcctatagaacatgtcttctcattggagggataagacctgtgtctatgaaacaggcgtaattacatagctctggaactatatatgccgaaataaatgagacagtaagtgttattgtactataaagaatgaagaaatcatgatgagaagtaacagttaatgaatgttttctagaaagagtaggatctgaattggccttaggttgtaagcagagtttatagatagagtagtggtatgtcagagtcactctgggtgcttaaacatacaaatccccaagtctcacccaaatgtgtcttcagatgaaaggaaaaaacaaatgacttgagctcccccgcaaagaacacgggtggtatattgagcagccaaggagtgaccagagtggcaggcccatgttgagggacaaaagaggacaattagaatatgattaatacaaatttacagtgggatgagttgttagcctgaggagcttgaatgtgaacctctgtgcaaaaaggagtcattaaatacttttgaaaaaggtgggatgggaagaaaatgacattctcaagacaattagatcgaacagtattaagcatgctgacttattaagttatgcaccttgagagggtggaatgagggaaaagggtctttatctggagtaagacaggaagaagctaagctgtaattcttactggactgtaaattatgtgcagatatattatctgtcatgttcgtgggcgcattctcagtacatagcacttgaaacaggtactcgataaattgtcaaatggatgcatggagtgatttccatgcaaaatctaatattgtatagtattagaagggggaaaaaagcatggcattatgctagcagaaatgtcatttggtattgaggatgaaacattttcaacagtttgcaaagccatccactcaaacattctgtcactttccaataattttgaaggatgttctttctacttctaccttattacacaatgagttgagtaagataaagaagtcatgtgcaacaaaacagagggagattttctgaaaggcactacaccaggaagttgttgtactcttgcttcatcttgccatcttggatatacttctggcgctacctccaggccagttcctcgttacatatgtcatttacttcccacatgctagactcaccgagttaatcattttgctgcagttaacacattttagcagagtgtaggtttatgggtgagaaggaaatcaatgatgtttcaatacagggttcttttcccatcccccttatttccacttagaactgtctctcaagtcttaatttgcctctaaacttttttcccagcttacattcttttctgaaaaatgcaacgacgatgccaatgtttgttgacctgaaatacattgtaaaacattcataatactttgagcagagcttccaaactcccatttgcctcttttatctcccttaccttggcccctttttgaaggcaatgtgatatttaatccgtttctattgatgcttcaaaattattgaaaaactggtaattgtatttttccctttacttatcagttgctagttgacaatgagtgtttgcccaaacaataaccaatcaaaaggtaaaaaggagattccagacatatctgagaagaaattctttggaagaagcccgtaaatggaatgggaattcaaacaaagccgtttccaaaagaaatactaaatggtctctaaatgcaaaaggattgctccccaagcattttatgggagcataaaaagctcccaacacattttatgacaatacttctactcaatgacttcttgtgttgacatatttgttgcactcgacgttagtatttacagcttcttatcccaaatatttacttaactgaagccctgatgtttttaaaaacttttcatctgtgtttaacagcccattttacagaaacttatttgtttcatcaggcagatatttactgagaacttgcaagtgccatatattctaaaaatgctgatgataaaactgtgaacacaatagattctcatggtgcttatggtcagggctagcacacacacttgtgaaatgatcactgatgatcaaaggcataaacactacatttggaagaaataccgagggatccagaagtatcttggaaacactagcaagtatagcagatggtgggattggtgcttcaaagaacttcttgtggaagatgttacgtatgtaccttctctgtgccaggcactgctaggaagtgctggagagaaaaagatgtgctagataccgcctctgtcctatgtgcttgtgctttgtggggaggtgagtaggataatcccagttctcatgcagtgtaatgagtaccatgacggaaatgcactccaagaactaggcagcatgaccagagataggacatttgagaaagacttcactcgggtggtactatcttagtctgggtgctaaaatagatgtgatagatgagtaagggtgacccggaagcaggagggaaagggaggggctttcagaacaacaagtgcgaggacattaaggtgaaatagagtataatagtattcccagatccttgggattgttctccattaggctaaaacaaaggtgttttctcttctttaagatttcatgactgcagattgcataacagaaggtcatttaatagacctctaaactgaaggaattcttgaattaaatcacaacatatcttccatggccagagaaaccattgcctccttatgtcgacattactaacagcaccagcacctgctgctcaggccagcgggagggttgggtgttgctgcctaggtaatgctcaccaactgatgtcctgccatgagtagttttgccaagttccacaaaaaaaacttagtgttctatcagcatctaatgagaattacagtcattagttaaataaaagaactattagataaggagcagaatgaacaacacacaatccatcagcttggtgaatggtatcagatggtttctgggtgctgggcagctgtgcatccaagtagacagggagaatatatatgtcctttgccttatgtacttgtttctctaatccaaaggcacagcaatccgtggaagctgctatgataaggtgtttagtggtgaaaatgtcttgaaagccagtagattattaaagtgatgtttttaaaaatgcagatggagagtaagtactttttatctagagtagtagttctcaaagggaggtcccgggatcagcagcgttagcatcacttgggaacttagacctgcatgggccccattccagatctcacttgaaaactctagggggtgtagcccggcagtctttgttgtgaccagctctccagggggttctgacactccaaatgttcaagtttcagaacgctactcacaggccatcatgctcggcatcacctgaaagcttgttagaactagaaagtcttggccccaccccaagcctactaaatcagagtttttgggagtagggccaagaaaactgtgggttaacaaggtctccaagtgattcttattcatgtcaaaatttgaaaagcgtcgatcgaactgttggttctcagctttgattgcgtatctgaatcacctggggagacagttgagctattccgggcccagatcacatctagaccaattgaatcagaatctatggaggcaggacccagacatcagtattttaaaatatttcttgaatgatcccagagtgtagctaaggttgagaaacactgttctaggattaaaggattaatgtgtttgagagtatgttaagatcttaggcaaatcacaagggtgttaagaactaccatcttcgcaaaaggagaatgtgcctcagatattctggtactgctttgattttaccttcagtagtcttacctattttgagtatgcttagtagtactaatatgaggcttattactaatatgttaaaatttgtcttttaattaagtgggtctaaacgttttaatctttaatctctgacccaactagaacttttctaaacattttcataatagtctccaccttgtcttctgaccttcacttatgttctttcagggttcttcgtgtgttactagtaatagtaatggcaagtgtttattgaacacttactatgtgaagattctaactggcttttaataatcacatcagctctgggaggtagaaggtagggatcctccttgcttatcaggtgagaaaactgtactatagagaagttagcaacttttcccaggtcataatatgtgacagctaaagggagcataatggttggaataaaataaatctactctagttgtaccgaaggctcatatttgtctcacgtacttgatttggtcgaggcccaaggggtcaatttccaatgcttggattcctggatatgtagagttgtattaaaaatgctaaaaacctattatgtatcatacaatcatacatatcacctaaagtattatggaaatgaatctgtattattaagggaaaaaggcctgtgtgaagaacaactgaaacttcattttaattgaaattaaataacatgcatcatacactaaaagtgcacgttatgaccccatgaattacttcaggtggctttgattcatgttacatacactaacaaatatagaagagtgatataatgcttcttaattaactactaatggaagtttactatttaactgcttcttatgtaagaatgtaaatgttttctgaaatatcagaacttttcattaggaagcacttttaaaaatagcaaaactgatatgcactatgatttccatatacattaaattgaacttgtaaatgatgttataaattatagaaaccaaggggatgttcaaattagatatttgtctaaataaatcatgtatggattgaacaaatactcattgagaaataaatgtattccttttctttcaattatctaggattccttgtttatctcttcagaagcaaaatgtcttctgtccgttttatttccagttaaacattcttcagattatgtaaataagttaacttccaatcctcttatttctgtttatctcaccactcttctaatttagacgtgatcaatatcttatctttttgcatttcatagacatcaggatccagaataattgagtgagctcaaaacaacaatggcaagaatgatgttttcagaaaactcagcaatcattcgtttaataaatattcattgcctaccaactataagcaaagtattggctaggccatgtggggtatacaaaaatgtattaaatatggctcattctccctaagaacttacacctattagacaaagtacatgcataaaaattataatgtataatagaaaataaatacaagccctagaatgcacagttgaagtacgatttgcatttattataaaaagaaagatgaattggctgggcacggtggctcacgcctgtaatcccagcactttgggaggccaaggtgggcagatcacgaggtcaggagttcgagaccatcctggccaacatggtgaaactctatctctactaaatatacaaaaattagccgggtttggtggtatgcacctgtaatcccagctacttagcaggctgaggcaggagaattgtttgaacctgggaggtggaggttgcagtgagccaagatctggccattgcactccagcctgggcaacagcaagattccatctcaaaaaaaaaaaaaggaaagaaaagaaaagattaatttcctgttagctaaatcaaggaaggcttcatggagaaaaaaatatttcaacacacacttgacgtagcagtgggatcaggctgatgttagggaagaatgaatgacattctacactgagaaagagatattcagtatatatatgaagagcagtagagaaactaacaagtggaaatagactcaatttacaatacttgcctgcctggagtactctatacgttgactgtaagttgcagtttactcagaacaatcccactttctacttgtttatcctatgtaatcatttattgggcctccttttgctctcaaaaatatccttgtttggataatagattatcactctgttcctaaatgaactgccctgtgtcctatcccagtaaaagggtgcattcgggcccttcgtaactgcctccactacatggttgattgaaaccagagcttggcattaagaagttagctgaacaatcagatttctattcttggaaaacccaagaatttcagaatagatacagaagctgtatagctttaataacatgacagagttgtagccttgaaagctatgtacaattcagaattatgagggagaagaaattgaagaaacagtagcagccgggtaaatgcagaaacaaatgagggagacacctagggggtgactgaggcacaataatggaagagaagtgcagtgaaattgcttgaactcttactgatgagatttctactgttgccttgaatccaggaccacctatatgttcattctttgtcatgctcagagttatgacagatgctgttattgaattccccagagactcccttatcgtctcacctcaaaccttacaataatcccttctatctttctatccatccaagctggcttaagtaaagtctatgatccatattcctagtaaacagagaagggaaagagactgaaggcaaaggccccaattagtaggctattgcaatatttcagggaaaaggcaatggccatcacattgttgtcccaggaatgagaatagaaatgaaagaagataatgaaagttgaaaggactgggggggcttgacaactgtttagacttgaggagtcagataaaataggaagccaaagataattcagaatattttgattttgattttcatcaccaaataagatagtagtactatgaagaaaaaatggttaaaaaacaataataataaagagaactcctccaaatagtaccaagggagggagtttaatagaggaaattaattccgtaggtgatgagagtcctgagaagccaaacgagaaaagatcaaaacaacccagggattggcagtcgcaggaagctgttctcacttatggctggggctttaagcacaaggtgacatgagatttcagaatttgaagtcgtctggaggcagctaggatcaggtggggcctgtcctgttcggcaggacctgcaaccacaggaggaggatgcgtcaagcagaaagttggaacacaagaggggattcagccataagccacaaaataccttccagagcagagagaaggagaaataccctgaattccgtattttccctgccatttagttccctgctattgccacacattgacgtattccatccagagaagtccattggcatatgagtctgggaaatgtagttcccagggggacatgatcttaagggaaatagacaatgactggtgcaacaactgacctgtgtgaggcaggagggaaaaaacaggaataatatagtttttctctagatcccttcatgcacaaagatgcaaaagaaatgtgttggcttaatgagccattctgggtggccctgtaggtggctgtcctacgaataagatttttagacaaaacagagatgacttcaaatgtcacaagaaaagtatcagacaggaattaatattgacttgatctgtcacaggcgtcaatgatttgcattaagccaacgatcttcattgttaatgtctgggaaattgccagcagcattacgactacttgtgtggattagtgtaacggattcccccactaacattcaggaaatcatgtcaagcacagagtgcctatgtaagagtggttgtgtctattcactacatttcttggactaataacacacttagccttcctgaattgccaacatgtacaaaaccagattggggttttttagttgttcatggaactatcatttattgggtagctcctgtagaagcaagatacagaaactctaattaggaataagacagtccctgtacttcaaagagctctcaggggaggcacacaagtaaacaagcaattattatcatacgttaggataataccgtcatggtgataaccactgagtgatagccaaacacatggaagaggtacccaagtctaacttggggtagtcagagactgctttcaaggatatccgagtaagtgttagctaagacatgatacgtatttctaggagggaaattttcaaggcaaggtggagattgtgcagtgacgcccagagcctggattattttggtgactgctagtatttcagaatgacttcagcaaaagttgtagagaagatagaagacaacaaagtataagcagaggccagataatgaggacctggaacagtggtttgctggtaaatgtttaacaagaggctcttggcggggagagagagtgtctgatttgcagcatttggcaaattttgttgcacaaatgctccagcatagccaatttcaagctaccagtgtgacgtcattgaatgcagaattggaaagaaacgggcagtagcacagcattgtatagttattttcattacccagatataatagataaaatatccagatggtatttaatagatatggatgcaaaatttaaatatatgtacattcatgtgcttcatgttactgaatgcgcacaacattcattatccattcattcacgtgttaatttaacaaacatttctgagcctctgctctgtgccaaacgcagttctagctgctggaattacagcactgaaaaaaaaaatttgtcctcactgaggtaagacaaacattattatgcccattttacagctgagaaattaagacatatgaggattaagcagtatagttaaaatcacacaattggtacatgaaggaatcaaagaggaaatcagctctcagattttaaatccagggactcgtttctgctataccatactacctacctagttgagctggattttatcatggtttccctatttttatcaccatgtggttggataagtaaaataaatatatgtgacctttcaaataaatttgggtcatttttcttggaagctcatctggtgtgaactttaaaatactgcaattaataatgattataataccctggaactctgtagcaacctcttttgaagaactccaaggagcctctaaatgtatcaaactaagttcttcaagtgaattagttatcatctgagagtaatatagacttttaaaaatgcattaattgtattaaccctttcaggcccatagacttaagtgtttctttctccaaataaaaatagtaatctctgtccattttctttagagaataatgaagtaattttcattgaatatgtagtcaacataattacttcaattcaatcgtgaaggattttaaaaattatttatgtctactaacttaaagacatgcatagatttcaagaacttaaaaatgcatattgcctctttgccctatgcctcataaaacaaaattatgataacgttgtgtgttacagaaaaacgcactgattgtaatgaagggtgcttcaaaggccatgaacttggaaagcaacttatttacagagacccccagcaatagcagctaaaagattgactgactccctttattttcagttatccttcagacacttttgacctcttcctgtgcctttctagtcatgtgcaatcttgtggatatctcttccttcctcttgttattttctatttcctctgtttctatttgtttctaaaaataatcatgtttgaatataggattagcttccttcccatctccccattaccaatctctcactataccgctatgttattaatcttcctgagaaatatatcaggttcattacattagttaccagctcaaaacgtatcagtggctttctagtcctcacaggctcaagttaatctgcatattctgactttcatattctgggttcatgcaaacttttcaactttccctcttatacctacttaggaggaccctcaggttccatcatgctcatgtttcaagccagaagttctcctgcctcttcctctatgtagactccacatagactatgatatcctgcttctcttttaatcctccatcttcagctcacagccacactcctctgtgaacagttaaatgattctcccacctcttacctcctatagcacttatttttcatgcagcatttttgagacttaattaaatctacagttttaaaaaatgtttttctaccacagtctcttattcatactaaaactttcaagtctatccattttgcttatacaaccacaccgttaggtcttttaggtccaagaatacaagagaatggcaaagcacgttgtttacatccacacatactgtgtaaattcaggtaattttttttaatcctatgatcctcaattacctcacctgtaaaataggtactactcatactgcagaactcttgttggaattaaataaatgagtgtattaaaaatgctcaacaagatttggcacaaaatcggtactcagtaaatgctaatcattattccctttctcttcaaagctccacaattctgtattcatatcaccctctttatatcatttgcaaaaatgtatcctattccaactctttccacctagcctcaacatttacaaacactcctggtgggaagggaaagcttttgaggagagcacatctatactcatttacttctcagggatgcaagctgccctgcttactgagggcatatgttcatagtcacaccggagcccactgtccccttatactctcaaatgggcagtagcaaatcatcttgatcggtagtaatgacctgtctctaaattttcacatgcatcagataatttcttttttagtaagtgttatcttacatatatgccaaaatatcaccattatatggaacactagctgaaagaaaaattattcagtagtcttaattttctagctaacataaattctctccattttcatcatccatttagattaaagactttactgttagctgaatattcagagactttattctgatttttaaaatttatgaggttcataatgttaagacttcaagggtgagctgtttgtgtcatttataatgcgtgactagacagtaactagaaaatggattgttgactttacaagatttctccccaccacgtccccccaaacctgtgctgctgtgtatttggcctgaaatctttacttctagtcaatctttggacctaaagcctaccagcttttagcatcctttaagattgacgtgtctctgggagaccaatagatgctaaaccaaatttcgtatgcacttggcaatataggataataacaaccatactccctgcaattgtttcctaacacagatgtaacaaattaccacaagctgggtggcttaatagacatttattctctcacaaatctggaagctaggtgtccaaaatcaaggtcaattatccctctgaaggctctggggaagaattcttccttgcctcttccagcttctggtagccccaggtgttccttgatttcaagcagcacaagttcaacatctgctcctgacctcacataaccctcttctttgtgtgtctttctgtgtccactcttttctttattattattattattattattattattattattatactttaagttttagggtacatgtgcacaatgtgcaggttagttacatatgtatgcatgtgccatgctggtgtgctgcacccattagctcatcatttagcattaggtatatctcctaatgctatccctccccccctccccccaccccacaacagtccccagagtgtgatgttcccattcctgtgtccatgtgttctcattgttcaattcccacctgtgagtgagagtatgcagtgtttggttttttgttcttgcgatagtttactgagaatgatgatttccaatttcatccatgtctctacaaagaacatgaactcatcatttttttatggctgcatagtattccatggtgtatatgtgccacattttcttaatccagtctatcattgttggacatttgggttggttccaagtctttgctattgtgaatagtgccgcaaaaggacaccagtctttggatttagagcccaccctaaattcatggtgatgtcattttgaaattcttaactaattacatcttcaaagaccctatttccaaatctggtgacattcaaggtttcagggacatgtgactattcaggggaaactattcatcccaccacatcccccttgaaaattctggaaaatgtagtaataaaggcttctgataaattagtgtggaaagtattcacggttataaattactaaaaagtctcactgtgagctcttaatcaaaaggccctataaaacatttatttgcttgattaaaactacacatccgatattttggttttggatttattattatttttagacttggaataactattttatgtgaaatagattccataactgaagcagcatacctctcaatttcccaacatttattttattattttttgtcttcacactacttaataactgaggaaaaatcatttagaccaaagttcaccttggttgacaccatccagacagctacaggaaataacaatggaaactaaatctctaagaaaaagagtctttcatgtgaaatattgcagagttgattctagatatatagctgttggaagaatggatactattacatagatatggcagagtggtatccagcacctttcaacaaagatctttcagagtcagtcttattatgtctggagaatttacccagggcttaggtgcttttactgacaatctaaccacctgcaccccacccaccgtctaaagctaaagtttattggaagacttaggaaatcagtcttcggaatgtttctgagactggtacacccaccacttcattaaagtgcttcacttcacttcattagacaagaagtaaaatacttgtcaggaaattatttatagtaccatgtatatgggtatcttatttaatactacttaatgatggtactacaagttatataaaatggagaaataagtcatcaagtttgacaataatgatatttgatattatcattatcttttttattcgttcccacagaagtactctgttattggtttagaaaaatgatatttgatataataaagaaggaaaaggtggtaatattctttattttttgtatctttataccccagctctttcaccaatctcccccatctctgtagttctcctctggtgtccccaggcagtgaactattcccagtggttagggaacatctcattgagtaagttacatcaacatttcttcacatttcaggacaacaggaacagtgccaaatcctagcccattgttcaactctcaagccttattatcctaataacacatccatcccaagaaagaattcatcaagatcagagaggaatacgtataattttttatagtacagtatttaaaatgaaacagcttttggcccgcgtggtctcagtgggctcaagggggaaattcaggatgctagctcatctcacaccaagtttaataaagggtgtcctataaaaagctaatttcttgctggtaaattgctttttaagtaatccttgctgttgcaagagacccattcatagcgctgacactgggagccatgttggaaaggctagatatgctctgggagataaggtaagatccaggtggaatcttctctttacagaatgacaatgtatatagctaatattgtcctttgaggctagtttgcatgcagttgctggtatggcactgctcagcagcctgctgcagataagaatgagtgatgatgccctagattttaatggaacttttagagtgcatgcagcagtggggtgcagtcttcagcaaagaaaaacgagctgacttgcaggcatgagagatcatcaagaaagataaagaaataggacatccactctaggttaggcaaggctttttagaggatattatggaaatgagcaagaaccaatttaatttttataatgccactccatttaactttaaaatacaaggtcaaggtactgtgtttttcataatgattaaagatttggagcactctttctgttgaaacatactgcatctgtttggcagaaaaaaaaagtgacaaagaataaaactgggatcagagaacaacaaaaacatattctgtcacttgcctaacacaagttaaaaagcaaaggaaaaagagacaactctgatggacatgttcatccttatcccaacagaaggatttatttacctaaggtcctattatttcaagttactttgatcccaggatggtaacataaaatgtacattttaaaataaaatggaagtataagatcaataaaaaccacatatctgtggataaaacagcagattcaatcttgtggctgaaagtttgctttaacccaacatttggtaaactattcactctgtaatttattaaaagacatactgttattataaaactatctcagtttgcatcttgttggttctgtcaaaatttcatcctgctaattctcaacttgtaatatctctgatatacatgattaatctattttaggaataaaacaaaaactacctttatcttacgcatttctaggaagtgtttttagatgtaaagtaggggtaattgtagtatagtggaaaggattttgaacttgaagccagaacatatgtctctgccaaaaactaggtgtgtgaccttaaataagttacttagcttcctgaatcttagtttgtttagcttttttctataaagtggcacacctatccacatcacagttttgttgtcaaaattaaataaaatactatattagaaagaaacttttagaaagaaatttataaactgaaatgtactatacaagtttaaatcattctcattattttcttaccctaaaattttgaccttatttttcttagcaaatggctgaatctgtaaaatttaacccccacgcagcatctggattcaagagaactacggtcatttctttatacagaatactaattatacacatatagcaaaacacaagttttttccaactactctgtgtttttaaagattcagtgtgggcagaaggaattttatcaactatgttaggggaaaaaagtctgaagaaatgaaaataatgagaaaaagcactgttgatttaagtgcaggaacataaaacttcaaggcaaatgtgaggccaactgagttcatatatatcctcacaaaatgatttagttaatttaaaaacttttctaataagcaacacaggtaatcccaaattctatcttttatagctctaagagtccccataatttattcagcaattatttaccacccacttattataagaaaagccctgggataagtcttgagaagaaactaacaaaaacaaaacttgattgtttgctctcaaaaagctgggtctaaaataggcaaggtaagattttgttttgaggagcccgtattttccagcactgtccattgtaacattaaaatagtttgccaaaatcctcactctgtgggtgtatttgcctagggtgctaaaattgcttaaaaactttgttatttggctaactaaaatcactgaatagtaaacagtagcattagagatggcagagacattaggtgtcatgcagttcaactgcttcacctagcagacaaagacattaagttccatttcttaaatttaactatctggttgaggatacacagtagcagagctaaatcaagaacctcttggggttagagtttttgtttatgcattactttgttttggaattaaaaacagtgcctgtttgctaagttaaattgaaaatatgctctgaaggagaaaaacagctataaaaatagacttaacttccaaactatggatcacaataaactaaagaaataatttctgtagcaataaactccaacactttccataggaccagaaaggcttgagaaagaggagaacaaaaaaatgctttggggcttaccatatatatggagaaagctaaatgaataaaccagttgaaagacagcgagttatactagtaacaatattactgatatcggagctctcacttataaattgtatattatgatcatagtgactaggtactttatatctgctttctcattccttcctcacattaattcacatgtaggacagattacctcttctgtttctatccagaggcctagagctcaggccctcatcgaagacagacagagctatcatccttattctaaaaaaaaactaagaccccagacatagctgtgctacttatagactagaatgtgagagaaaaagacaagctttcatcatgggcttaacaaactgaaacacttcttcaattttgagattgagaaacttagctaatgctaggtgtaaagatgatatgctaccttcataaccttggtgaggagaaattagcatttctctcagtcctagaaggaggatgaccatgaaggtcttcattctcttgagaagataatcaaatgcttcactgccctgttaacggtttactcaatattcaccaagaaaagtagatgggattatttttgcagacacttatacgggtaatttattctgataagcagagacatacctttagtgcataaattgttccctttgtgctctttgtaataaacatcaccatagagaacaaacacgaagtaatgacattgaattaaaagacaccatagaggcaacagcgactggaatttgtgaaagtaaaaggatagtgcaaacagttgtgcgttgcattctgctctgaagattaacaagctgggtcaggctttgaccatcatgatgagcaggagatttttctaatggaaatccccaatcaagttcctgctgcacccagaaaggaacggcttacagaaatcttacatttctttgcacataccaaattgcttggcatattctatcacaaggtttactttccagggaatgtgatcaagaaatcatgatcctaattcctagttaaccctcaaagtttctcagaacagtcagtgcatcactgtcaacttttgtgcaatgtggaaatcagaattggtcacacgtttttccggccactgttttagattcatataatattagtgaaatcatgtcagactggtatagccatgaatttatacttcatgaataggcactcaataaatagtggattaaatcgaccgatttgatttttacctccaataatttcaaaaatatcattgaagacaaggttgttgaagctgtcacttttcttgctgaacctttgttgtgccaggaggaacagatggtaaaatcaaaagtgattagagaatcagtggggtgggggtgagattggaggggagaggtcttcccagtgagacccgctagcgtcttccctgagcagtatgttaacccaagacaattttagaaatctgtgcccctaagttgcttgacatccaaagcacacttgatgcatcctacatttctaaatatttttattgttgtttctcggtagtaatcatctggtttagtcactctaaaagtcaaggatgaaattttaaaatgcaaataaaagtgcctactttctctctttccaattcctttttgttttattgaggtataatttacatgcacaaaaaaatcgcctttttaaagtgtacagtttgatgagttttgacaaacatatgcagtcctacaaccacgtccgtgatcagaataggaaatatttttatcacttcaaaaagtttccttgtactcccgttgcagtcagtctcctgccccaccccagcccctggaaaccactgataggtaaaagcacttttaatctgaaaggtatttaatgtatggcagtgtcagtggtaataataacaagatttattcattggttcactgtatttttgagcacttatatgtgcccgttgtatgcaacccattatgctcaacccctgccctcctcaccagggataaactagtggcagagatagacaaagaagccgtctctctatcacccctatcttatagaacattcttcaatgttagaaatgcagtataatgtggccattgagaacttgaaatgtgcttagtgggaatgaagaactgaagttttaactttatttaatttcaattaatttaaatttatatagccacatgtggctaatgactatcccactggaaagtacagcttctatacaatatgataatatgatacattataacgcaggagtttaaccaagtgctaaagctttactatcaccagggtcactggtgttatgtgaaaagaaaacttacaatagaaaaataaatcctttaaatagtcacagacctgagaaagtttccttctcaagggaacacacattggctcattcaaaggaggttaaaaactagcatttaaggtaatttcatgaagctttcctttggatttctcatgcttattgtatacataaataggcaattttcgatgggacctaataaatcactgttttttatttgaacattttaacaaaattatcaaacagcattgcatttatgttcaacctatttgttctgagaaagacaacgattaagtagaagtcatcaaagttaccagaacaatttttgttcttatgttttagaaggcattgaaggtgtttaaaatgtacacttatagagtcagagtactatgcaactgtggcccttatagtttatccgtcatgcatctaaagccattgttacatctgtttctaattgtgcatggattgtccaagatacacaattggaaattccattttatttatcaatttgaagaggtttcacccatgtggtcactatgatcactatggagtcacattaaattgagaagtctccagaagttgcagtatttatttaaaattctaactttcttcagaggaacaaattctccatttctggattctgaatcctcattagccataaggttgttgtaagaatttgcagctaataggaacacatcctggggagagaccagttgaaaagtaacttggttctgagtgaaattatacagagacagtttctacttcaggtggtgttgctaatgaagctatcatggtaattttagcccatatgatccctaaacgacttcagaaccacttttcatccactaagaacccacttcaaccactgccacgttcactaccacagtataatatggaacaccctctggaattcagtaagtaacttcttaactcattggctatagagctttgcctttgtaaattctttccttttgcagtaaaagagattgtttcaaagtaatccaattagtccctaggcatgtctagaaaggtagagtcaacaacagtaaggtaatagtccttataagatatgtaagaaattatcagtcatttactttaaaataatttgtacacttttccttttatatggttcttctatgttgaagccagtggtcatccagtgattaagattagccaaactcaaaaggctaaaactaaattcaaatggtattattttgctttaattttatgcaatgctatgtatttaaatttcatgaaagtttcgtatggcattgctatcaatttcagtcaggataaatttcccgtgaaataatccacaattttcaactgtacgttgggtacaggtaaggaaacacccttaagagcttatccagttattagctggtattataaatttcaagtaattcaatgttcaattaataaacagttactttaaatgggaaagtatgagtcaagagttagtacaaaggagaatcttaaaagatgaacatcaaagaatcttactattgatttgttggtgcctttgcttgcacttctccaaattgacttgacgttttaaatttgtactgataatcatcagagtcaaatctgcttttaggcaaaaagtatccgctagttattcccctactatgaaagtgatgagatgaattgatcatgtctccagtgtatggatggatgtctttgaggaagacctactgaccttatgtttatcttctgtcagcatggtgtgactatgtggagagacagtgctatttgctaaatactttgtttttcaaataaaaagatttcacagattatgcattgtagaatttataagtattcttttatgtctttgaatgtgccaatacaatttttatgaagttggaactattttatctattttaatgaaattgtaagccttctgtgaattcttttattaattttattctgaagaaaatctgaccaggttagggaaatcaggtcaggttacgacgtgatcccagtggaaaagctgaactgtggactgtgatttaaaatagggaagaggtactgaagtgttgtttttatttttgtttacaaatcagcctttctaactattatgtactcccatccttctatctttttctccaccagaacgtattaacaggcatgcatataattaatgcttttcttgagataatattaaaattaacttcatctgtcaggccgtctgggctaaaagtacacagtcagatctgggtaacatttgagttgatgtaaatatgcccacacatactgacaatgcttaccatttattgtgtgaatgaaaagcagtgtaaatattgtttgttctactagggaagctccacattttaatcaaactttgaccgtatttctaaaatgccagagcatctggaattgttaaaggaactgatagtttttgtgtttttaactgttaggatacttgaaatccaaagggtaaagaaactcagctgatttatacgtttcttcctctttattttaatgtgataaaatgtagtttttgtcatgggctgacaaacagtggtagactacactaactctgcgtttgctgggtttaatcttaccctctcaaggcatggaatgggagctcacttcagacccagccatgcttcactgtccactgccttctcatggatatagtgtgaacattaattagatgaattccataaagtgctttaagctctttggagaaagatactcgctgcataattattcttaactcccatacgctcttatgatataaaccattctgccaggaaatcctttttagggattatcacttaaaatgaaattttcattattaaaagcaggaagaatatacatctactgacagacgaaaatgtgcttaaggcgactgcttttaaataggcagaaatcctgaactatggagccatccatgcctgaaaatactgagtaataatgaaaactggtagcaaatttggaatattaatcatcacattaagttgcaaagaaaaaaaaatacaagccacatgccctttaaaaatacgtgcacaaatctttattctagaaatatataactttaggcctaaaaaagtacaaaaagtaaattattttatggctctgaaagtatccttaatttactcaggtgacaacaattagtgtttaaagagttagttttcaatcttagctacaagttggaattactctggaagctctaaaaaaacaaaaaacaaaaaaaaatagagatgcctagttcccacctgcagaaattctgatttgatttttctggtgcgagacctgagaataggaatttttttaaagcttccctagtgattctagtgtgccacctaggttgccttaaggtaaacctcatattatgcagaacctagcaatcacctatcctgattttatagacgaagatcataagacccaagagggcaaattgatttattcaagattgaatatacaaatgatagaagattcacataagatgcagtatacagagtggcttgtggattcttgccaatgcaggcagcagaattttctttagggttcacccagttcaggcacctctttgcagcagcacttgactaaggttcttctgattggatcattatatgggcaaaaagaaaaagcttaattgaaaagagctgaacccacattgtggaatggaagatatacagtttacacgttataaatgattaatattcatgaaagcatactgccctttcctcttcccttcccatagatgacatcattgcattggtgtagttaggttggtggtttcttgttgttgatcttggttctgacacagttcatcacttattatcctggcttattatctacttctacattcattgttcactcactcactaattaattcaacatggtttttattgttttggaccggttatatgcctgcaacgctacgtaaggctgaggatattacaatgaacaggaaacaaccctgaagtttaaggtatcaagcctttgagttactgtcttttatcatagctgatataaaattgaagccccactttttttgttttcaattactgaaaattcagtgctaaaaaaatgtggatttttattcaactagataaagtactacaattaggtttccactgaccttggctgtttttgttcccagttgccattacataaatctgtgccactcacaacttaggaagggtgtaacattctctgtaatagtttgcctttcgaatagtgtttggattcattactgtccctcgcagtttggaataatgaccactgaataatcagtgtttggagactaaattagtgctgcaaaattccctcaaattacctactgttcttttccctgtcgatgtatcctcatattcactatgattaccctgagaagaaagatattgttgagaaccactttacctactcgaagttttggtatttcaaagattcatacttatgtcatgttgattacattagcactaatactattggcagaattctaattcacgttattttctttttttccaatttctctccatgcctatgtgttgtcccttcgcagctataaagccatggccgattcatgggtgcttttgttaaggcgttcagcagtcacgtttgtagatttttgaatgggacttagagcccttttttgttctttatgtatttctctatttctcagcaaaggaaatgcagacatgcaagaaatagtgatcaaatgtcctgtgtactattgtgggtgtcattaatggtatagggagaaatagaaaatagttgcaaagatgcatttaacaaataaacgaggtcttgagattcaccatgaatgtggccccttctatgaaaagtagttaacatccaactgcaaagttgtactggatcagtttgactttaacctttagctaatatgaaaatatggaattgtgtggtggtgctcacaaaaaagaaaactcatttttcttaattatcatcaattaacatgtactgactacccatgagggaaagttaatttgctcttgagtggaaccagttatttgccctattatttctcccttgcttattcccctctccctccctcctccctttccattcaacaaagaaaaatagataaagcaatttctgattagccagtgaaagcctctaacataaaatttccaaagatgtgccataaattatccacaaaatgtaaaacttttcaattttggtttgcattttcttttttcttattataaaggtaataagtgctcattatagaatttgaaaaatataggaagttgcacggaagacgaataaaatcagccataatcctacaaacctattgacacttgtacatatgtttgttatctctaatgcattcattatgataatgcatcttttcaaccaatagagtaatcactggtgactttcaaatttgcctactcatttttcactctgtggacttactttactacctcttgccctttttcagtaaatgaataaatatttaagtaagtaaatacaaatgtaataacttatgcgctcaagcacacagatacacacagagagaatttggaacttcggaaatgccatcctctccctagggccgcaagtgagttgataagcacgtaaggaaggataatcaggggagccttctcgtattgcccagatggctcaaaattcgtcatctctaccaaacaactatttggagctttgaagaaatatccatgacccctttgaattcttcagtttctttcgcgttcactttgagaaccaagtgacaagtgaatttcctgacttggtcttttaaacctgttagcgcagttccattgagattttgtgggcacaagattgcaatgaagagatcaacagggagaaattcatttccctatatatgtgcgattaatccggagtgctaagggcagatataaagcaggtgcctactcctgtataacttggaataaaaccatttccaaaggctgatgatcctcaagtcttgttctgcaaatgactgatgtataacttcaggccaatttttctccagttagtctgtgtcactgggagtcccatttctcggggagcagccccatgctttgtcaggtgcggagcccacagaaggttaatgcgaaaagaaggcctcttgccagactgttttccagatgatacgtagggttattagtttgagctccttaagaagatttttctcacctgtcctaccaacttatgtttatttcattggtgttagagggtttcagtggcggaagtaaaatatttagcggggaagggacagcgttcatgggaattttgcctaacttaattttgtatctttagctcattcgtagtcattgtactttgtgttttgtcaactgaattttgtttgcatacaaaggcacaaaatgtttgcttcagacctgtcactcttatttttagcatggttagacaaaaactgagatgctttaattgtctaacttatcccagtttaagtgctgcaaaatctcccaggcaatgtcatgggcaactaagggataaaatcagagatttaaaggtgccaggtttcccacgcttctaacagttggcgttttgggtgtatacaatccctcagctttcttctttagtttatggagtcttgtggagggaatagcaggtttttagctaaaattatcatgctgtcgagttgggtctctagtgcatcctgaagagcttgcattatttacagaggctgggctatcattttaaatcctgatgcttcaatgcccgttatcattcttgacaaactcttccagcccgtggtctgttttcctctgtttgcttccatttactttcctgagcaaccagctgagcaaagatttacataacttttgtttaaacaaaccctgtacagttcactctttcagccagtatgtaaacacttttgagacacagttacatttttctattttagtcccagattctgtttatttgctacattttttgtgcccacatttttgtctttgttaagtctcttacagattcacatgaaaaaccagaaaccgtggctgctcaaaagtcattaataatgagatttttagctactgtttctgcttgtaaattcttcatttcacataatacagtctcaaaaggccacagagaattcagcctcgcttatctctgtgttgcagatgatggcttctagccttacccaatcccagtgcagcttgcttgccatccaggagtcgaatttgtttccatctgacattagcgtattaaaaagattggagatcaacaagcaacaatgttcttgtagaaaggtaatcaaggtttagagcctgtgtgtcatgagactcctagcatttgaaaccgctaaggggttgaccaccattgtcccaagcacctgtttaagattctttcctatgataagggacctaaagtgattagcatactgataagattttcctagaataacctatttatttcagtattattctttcaaatcttaattaccatcttttcctttacccagggtcttctttctacctctacgacacatttaattacctatattccccaacctgtaccatattaaattttgaatggaagttttatagggtaatttattggaaggatggccttgagtgtcattatgttcaatgaatgccctattttgacaaagagatgactaaatgttattgaaatctttttaatccaccacgcttctgcttagatgtaaatgcaaatctgttctttacatttgtgattgaattgaacttgaaaagtaccgccatattgattccttctgcaaataaaatataattacatttccctaaactttctacactctcccaagagattggctggctttgtattgtagatttttggtgatcacagaggacaatgcattatcataagaccaataagatttatttttaccttggtaaagaattttaatttatttctagtttcattttcatttatatccatctcttctcaccctctgctctacaaaagtatatatgactatataaattgaaaaaaatatcaagtgcaaaattacagaaataaataattaggttattttagtggaggaaggtttgttgtgggtggaggaggagaggagtgagccaagaaaaacgagggaccatacgtgatcatatttttgcagctattttaaattgtttgtgtatatactttaaaatattataaaataaaattttaagtgcaatgcatatttggagccaatgatgagggataacttcagaaacgtagcatcatcatctagtgctttcatagtcctttcaacatttccagatagttttaatggcctgctcatggaggcaatgccctaattttaacatatctcttcacaactctgatttcttgcttcctaacattaaatgtcttcaaagcttctttcaccactaattccttatcaagaggataagccagtttattctttaagaaaaactagctacacaaaaccgtaagtcattccaacataaatccttcactatcctctctctatagatttggttttgattcctcctgctgaaattcaaccttctttcttcagctatccacacgtcttaccctctaacttccctcaggagtgtctattagctcccattacagtgaccacagtaatatagtaatcccctgctgttctcactctccacttccttacactgcgttttaagtctcttcatattctttatcaccttgtatcatgcatcggttttcttagttgtttattttatgttgccttcataaattccatgagagctcactgccgtatctttagaacatggaacagtgcttggaacataatgggcattccttaaatagctgtagaataaactttcaaaatcaacaataatgtatttgccaaatccattggcttctctgccattttatcttgttcaataccactgcgatattccccttcctttttttttttttttaaagtctgtaaccctttagcttctgtaatattcctagttttttattcctctcatgtgtcaaaatcatcagttgaggcttattgttttctctttctcactctgacctcacctttgtttacatctcatcttctggctttggctatcctgttttttatctctgttccaacctgtatttctagccctactacctggacatgacatgtggatatctccgtatgaccgcagtttccatatgactttgcaaattcatccctgctctcccctccaaagtcatccccacaattgacttcctgttccttccaacctattaaggttcaaacccacttttgctcctcctttgcaggctacacttttccttctcagtacctcttttttttccaagttcttagataaaagtcatagtaccttacgttgtaattgccactggtctggtctttctgcctgctttcctttccatttgtaatcacattatccattccaatccatttataatactgtgatcagccataaaaataacatttatcatatcgtttgtctccttaaaacctgtagtagatcccctctatttacaagatctggtataaaatcacccttcctgatattcaatgcctgttttaatataatctcaatattatgcgtcataaatccccctgtgttcttgcactttttatttcttatacatctcatcaaccatgtcttatcaactctcaaaacctgtattggttttcaggaaaactcataaattattcttttgtagaccttttgtttgtcatctttgaagatctctctctgaactacaatattttgtctgtataatcaatttggaaattcatcaggtattgaaatatgacatgtcttctattgtcttgaacattaattaaaactttatttgactttttatatgcttacatcttgtttcctcacggagtgttaacctactagaaagtaatagtttaatcttatatttattttaattcagatttagtagcatactttacacgtggtaggatgtgtaactgccttacaccttgcttacgtgagttattaatgttttcgtatatttaatctgaggatgtactagcaatgttaaaactgtaccgcatgaaattgagtaattgaactatttgttttaaatgtgttgcttaacttattgtaccattttctcataatcacagctcaagttaactttgtggttgtacgtattatttcttgtgaaatgccaacaaacttagagcaaggaaaataacaggtataatcatactataaaggcaaccttaacactagcatagtctcttagctcatatggtaactacaataatgtacagtgacaaagagaatattgtactttcttagcacacactttcctactactctactgttgtggataaaaacagacatactttaggagaaactatgttatttccaaataatgccttaaaggttactccaggaaaaggcatttacataaactatctaggaaaagaaccttttaaataatataaagagctcacccaaaaggactgaagtgtttagttgaaaaaaagtaaaaatgtcgaagactttgaaaaatagtttcttgcagtatattttcatcgcttccacttacgttatgaagacattaagcgctagtttatcaaaaactatttttgtacatgtcttctaatgacagaacaatgtcaacatgattttcatcattgagaatgcgtaaagaaaccctttgtacagttttttctatgaatgttcccctaagattaaagcaaatttccaacacgaattaggcactccgaaaggaggaggggagggaggggagcaagtgctgcaaaacttcctgttgggtactatgttcactatctgggtgatggaatcaacagaagcccaaacctcagcatcacgcagtatacccttgtaacaaaccaacacatgtacccctgagtctacattaaaaatagagattaaaaaaaggaaatcagtatataatctaataaatacctctcaagctttctcatttttaaaataaaattttagattattattttaggaataaaataggctcttcattgtatataagttcatttctgagttgcaaaaatcctctctttatgtttttttccccgtattagcatgtttttctcctgtttttccccactcaacttggctgccacaatcagaaagcacaaagacaattttttcttgcgcttgtaaatcaaaaccttagcatcagacaaaataactgctccaggtctgtcaaatagattcatttgagctttcttcatgcattgaatacggcagaatttctgacctgaagaaatctagccttttccaaatttgctttaagaacattttgcaataaatttaatataataaaaggaaaaaacacatcaggctagaatttggaaccgattgttattaaaaatctcaagtctatcaatttaacttcaacaaattacttaatttctgtgatggttaatttcatgtgtcaacttggctgggccgcagggtaccgagacatttggtcaaacattattctgggtgtgtttatgaggctgtttctggagagattcacatttgaatcagtagagggagcaaagccgattgttctcccttgtgtgggtgggtctgatccaatcaattgaggacctaagtccaatcgattgaagacctaatcaaaaagcctgattaaaaggaactcctgcctgatagctaaagctggaacacccatcttttcctgcctttgagcttgaattgaaaccttgggtcttcttgagtcttaagcctccagttctggggctggaacttaacgtcattggctttcttggttctcatgcctttggactcagacaggaactacatcattggctttcctgggtctccagcttgctgactgtaaatcttgggacttctccagattcgtaatgagccaatttattacaataagtctctccctctctggtttcgagagagagagagagagagacagagagagaaatgagagcacaagaacgtgagtgtgagagtgccctaatataatttctctaaatatcactggttactcttcaaagttataaaattggtataaaaggtgacctcaatttttcatggagttaatgtatgaaagtcacaattaaaaaggaagaattagttctggtgtcctgaaagttatttgaataaattaatatgctatggaggctttaaaatactatgaaaatttaatattgtattattcttagtgttgctatttttaaatagcactttttcttttcctttttttttttttttttttttttttttgagatggagtctcactctgttgcccaggctggagtgcagtggcatgatctcggctcactgcaagctccactgcccgggttcacgccattctcctgcctcagcctcccaagtagctgggactacaggcggccgccaccacgtccgggtaattttttgtatttttttagtagagacggagtttcaccgtgttagccaggttgttctcgatctcctgacctcatgatccacccaccttggcctcccaaagtgctgggattacaggcatgagccaccatgcccggcttaaatagcactttttcttgtgagtcactttttaaatatttgtgcaaaccttgttgccattctactcaagctaatatcctaaaccgaggacattataacatttcaggagtcaaaacttcagacacttaacatagtatcctcaggttcatccatgttgtcataaatgacaggattttattcttttatatgactcaataatatcccattgcatatatatgcaatattttctttattcatccattattaaacacttaagttgattctatatcttggctattgtgaataatgctgcaataaacatgggaatgcagatatctctatgacatactgattttatttgctttgtctctgtccccagtagtggaattgctgtatcgtatggtagttctatttttaagttttcgaggaacctccataccgtcctccataatggatgtactcatttacattcccaccaacagtgcataagggttcccttttctccatattcttgccaacactttttatcttttgtattttgataatagccattctaactggaatgagatgatatctcattgtggttttgatttgcattttcctgatagtgatgttgaacattttttcatatgttgtattaactaagccaaacacagaaagacaaatgcagcttgttctcattcatatgcacaatctaaaaacatcgatctcatagaagcagtaaatggacggtggtcaccaaagaatgggggaagtaggggaaaagcgagaatggggagaggattgtcaatgggtacaaagtcacgattagaaaggaagaattagttctggtgtcctgttgcatagtatggagactattgtcaacagtaaggtattgcgtatctcaaaacggctagaagagagggttttgaaggtttctaccccaaataaatggtaaatgtttgaggtgatatgctaattttcttgatttgatcaagtaaaggtcttaattgtttggcaattaagactcatgaatacaaataaaggtcttaattatttggcaaagcatgctgagttttgtaaacaattcagtagtgatttttgagaataggtcaatagcaaatattaattaaaatgtcttctatttatgacctacagctagatggtaaacagatagatgatagatagataactgatagataactaatagatgacagataaatgataaatagataaatatagataatcgagagagaatacctttcccttcacacacgtgcatataggcacactccatttctatcatagttaccaggattcagacattttgtctcactatttttctcaatgtgaacatgcatataggaatattatagtttttgttctgtgcccattttagttcgttttttaatatttcaggacaaaggcaatatggcggtttcactttgtttttcatttttgcttatactttttaaagctcagtgtagaaaagtttgaaaatacacaaaagtattaaattaagacagctgggcacagtggctcacgcctgtaatcccagcacttcgggaggccaaggtgggtggatcacgaggtcaagagatcgacaccatcctggccaacatggtgaatcccgtctctactaaaaatacaaaaattagctgagcatggtggtgtgtgcctgtagtcccagctactcgggaggctgaggcaggagaatcgcttgaacccgggaggcagaggttgcagtgagccgggatcacaccactgtattccagcctggtgacagagcgagactctgtctcagaaaaaaaacaaaacaaacaaacaaaaaagcacctatagtctttctcccataggttgccttcttaatgggttttacaccttttgatgttttcttgagttctgtcccattagcaagtagtattgtacaaaaaaaattttatcatcttttatttaatattttattgatgtttaataattagaattattttaaattttatatgtcattttaaaatgcaatacaatatagtaaactcccagatgtgattgtaaataattaattattctcccattattgggcattgggactgcttccacattttggtcactgcagtgaacatccttgtacatgaatctgtatgttgaagttgatttcattccacactccccttcattcaaggggctccaaccattctcgttttctttcagcttctttatatccaggcatataaagttccttcctgactcgggagcgtcatacatgctgttttctccatctggataagtagttaattctgttcttctttgtgcatctcccgtttcagtaacttcatctccaaagcctttccaggtcactttatctaaagttacaccataatcttgcaaatcctcaactattgagcattattagtctccgttatcattattctccattattctctgtgaaagcatcccgtgattttcttttgtccctattaccacaatatgtgtttattccgtgtatgtacatctttgtttgtttattgtttgtctatacctgcaatgaaatgcctaaggtcaggaactgtctgatgcaggatgcaatgcgctcaataaatatttactgaacaaattaattcatttgctcagtcttgcaggcaaatggtacttctgtatatttaaatatctaaaatgaaagcgttactcgttactgttggttgtcaatcaaaatttaaatgtcgatgtttaagcgtgaaagacctctgtcaagttaatctgtacttacccaaaggctattatgtagaagcgacataaatattttcctaaatgttgattttcatattttaagaagacaatgaatgtttcaaagcattttcttctacacagctatttattctggagagtggggcatatgtttcttaatattgttaaaattggcaaggggatactgttgctatatacaaagaacacctaatcatcatgcagacgttttgtttctggctctcagttatgaaaagcagagattttaaaaagttacctttatatgctaaattaggaatggcagaaggtaatattctaatgtttataagtggttcttctctgagtccttggtttctatgtttatgaattctctttttgaaagaaattatagttattattaccaggtctattcttttacattgtttctaattctatggtgatcttcaaaatagagtatcaattttaaatacttgggaatgaaattattcttcccatatcatttctttgtatggcatacattgtgatttgttgtcccatcattgtttcagtatgacctgttactgcaaaaacatattgagataaatcatcccacatactctcggccaggacagacatcacactgttgcagcaacacttcagatgagccccattcaaccttgtgtttttatagagaaggatgccacatgtttatattcatttctgaagattggctcatattatttattgaaacatactagtttaaaaatctgtccatttatataacacctggtctatctacataacttgaattacataaatataaaactaaacttcccctcttctccagtgtatagcttgcaagcaagtgcatgtgaaataaattaaagccttgtttgtgtttttttcatcatgtgagtacaagacttttcaataaaaatgaattacttttgaacatatttgtttggacaacaaacaagagaaaagatctatttgattgatagtggacagaattttcattaagttcaacagcagaaataccacaattgcatcattcaccttcgtgtatcaaaagaaaacagaaaattagatgtgatgaactctacacaaatgttcactatgcatactttacccattaaatacattatcaagaatcatgtcagcatgacattctaatatagcagctttacaaaaacatgtaatctaatctagggatgctgttgtcctctttaaatcagcttcaaacatattctgggttgatatttctcattcttttttgatccacattgtttattcacataatgattatatttaactgaagataacagcattatcaaagtgaaagacaaaatagatgtttaataggaaagtgagtatcgaatcatcttttttctaccaaaaacatctataattatgaagtatttggttaattattttcacaataatttaaaagtgtacaacttgccgatttttttgtactttctacttttcatgtctcgcatatatctctttaatatctaagtatttgagtcagaaaagagccagtaccgaataatgggaatctcactgaaatgtgataacaatctggggcctggtcctgggacctttatctgcaggacaacttggacaaatatttagacccccaattcctcgtctttaccctaggaataataacacatttttctgacctcatacttcacgtggatctcaaatggaacaatcatctgatagcactttatgaagtatatgaaagcaataaattatcacaataagataattgcaattattctttggcatagtattagtgatgtctttatctgtctgacaaaatcaacatttctgtatggtaactgcctttccttgttttaacagaagatcatgccagaaaagatgagtaggtagatacttaacttgttgttcctgaatctggaatgtattgcagatgtcccagactgatctttgttcttttttttccttacaaatttcttttcacattgacagtgtgatatttctttaaatgtgcaatacatagctaaccttatttgtttgtgtttactaattaaaatatctaaactgcttaaaggagaaaattcagttttaagttttattgatttatacccttcttcaatccacataggattagggtagtatgtaacaaaatttcaaactataaatgaaatattgagttttgtattaaggccaaggatgaggaaaaaaaaagtaagtatatatggaaaaagaatggtattgaatgggagttttgatggagcatgttgacatcatgataatacctattatctttatattctgaatgtcagaacaaaattagagcaattttcccttatttccctacaatacgtctgtcttaataattctaagctttcctgatttcagtagtaatctgtattttgcaaaaggcagcatgtttataagatatcaagtaaactaagtttatggaacttgtaacagcatttttaacaacatttctccctagatagttcatggtagacatgaatttattcaaaactagtatgtagaaaaataccattaacaaaagctctgaaattatattagaggagctgaataatgttacttgagaaagaataaaatgttatttatgatttttggtatcttttacccactatatatggccatatctctgaaaaactttagtaatatgtactaatgcaaatatggtagtaaattatgtctacaggtgctgataccatagtagataaagtatgataactttattttaaaatatcatatttaaataattaatatacagtactgggaaagactattttatctattctctcactcttgaataaaaaaatccagaaaaaaataccttgttttggtaagattatatcaatttatttcccaaatgggtagagggttatttttttctgatcataaacgtatgtctcttcattataaaaatccactaaaagtgatagaagaaaaccaaaagaataaatgtaaacaatgatgccattttccaaaaatcaccttcgacatttttctggatattgatacagtctaaatctcttttcggaagactccctcctgtgtaggttccccaactactctgcaatcttatttcctcttgttctgttcttgtagaaaggagacccattgtcaccatgtcaaataacacaaaatggtgcacgtataagatcattgtctctgtccattatttgccagaggacctcaaactttttcaggtggtgggcaactggatgtcatgctgctccttgtacaacagaacacaattcattatttatatggttatttcattttaagaaaatttaactttcattagctggaaaaaaaaagaagtggtttttaagttgtttagaaatgtgaaattcaattttcatactgcaaaagagattcaactgcaaacacaggcacacatgtctggtgtaagaacgagttgtcatacaaacccaaattagctgcctccacgttgtctttgttaacaagtgtttgtttgctccttgttccatcattcagaaatgctctttagcaggaattgatggaacacagtcgcagtgacctcttcctgtctttaaaaatcgagatgacatttgcccatctgcagtgttaacatagttcctcaaagaccactgacagtggggtaggactgtattgcgcaagttctctcatttccctagaatataattggtccagggccagagattttagctcatttagagcagcaaggtgctcttttaaaattccctcacctattttgggcttcatttcccttatacggttatgccttttccagtctgatgaacattctccttgacagagcagacaagcaaaaggagctgcacactgctgctttctgtgtcgtctctatccctaaccttctcccttctgccccaatcagtgaaccttcgtctttctggttcttcttcctccaaatggaagtaaaaaggccctgaatgttgtctttaccattatcacgagcctcaattcattccaagctcagcttttcctcactgtttatacagttctatattgttcttctaatatttgccctcagttctctgtccctcgtttcttcccatgttcatactctattagaatctgagcacctttgaggttgtccatacagtggcacacatctttgttttatactcactgggatgatttgccattatattgtcaaaattttattctaaagagcttttacaggctttcttgagccattttctcttgaaattcaagatcgttgaatctctacgctttttccttcttaatctaataaacatacacccccacatacacacgtgtgttcctgaaagacagatgccacttgactcgtcttatagattgtctaaattgatcattgtgtgtggggataaaagggtgaattgtataatatccctgatggttcacgaagtctgttcctgtataacctgattagtcttctgaactcttttaaattctgtctgcaaatgactgaggtttggcaatcagcctatttcagttagttgttttcttgcataagaagggtccatatgtactgtgtgaagtaagagagagaaagtacttagatttgctggatgccctgattgttagcatggctaaggtattgtgtaagtaaggagagcagttaaaaatgatattgtttttatttcttaattgaggtaaaattttatataagatgaaacagacttatttgggagaggaggaagagtttgttcttacataacatttcaacctgtcatatttagttgagaacttcaatctgtcaagatactttgtataatattcagattctgccatctaatatattttccacgctttcttactgggtgtgacagtaacttatactgtggcaggtgtataagttagtaaagatattaaatgctcaatctgttaacttttgtgaagtggtcccactgataaagtgacacctcaataaaataaaaatttccattacctcagaaagctttttcatgctaccttccagtcaattcccagccccaataggcacctattcttctgatttatatcaccatagattagttttgtctttttaaaaatttgtataaatgaaatcatacaaaatgtactattttgatcagcatactacttttgagattcatccatgtaagtgtatcagctgttcattcctttattgatgattaatattctattgtatagatataccacaatttatttatctattctccttttgatggacattcaggtggttttcagtttttggctgttatgaataagatgctgtggacatttgtgtacaagccatttgtgagcatatgttttcatttagtttgagtaactctgtagaagtggaatggctgggtgaaatgtttaaatttatgagatattgtcaaacagcacctaaacagttttctaaagtggttgtgccattttgcaatgccaccagtgatgatggagagttccagttactctacatctttgtcaatatttggtcttgtcagtcattttaatttttgctatcttacagaatatgtaggtatattgttgtggttttaacttatattcctctgattactagcactattaagcatcttttcatggatttattggacattcatatagattatgtgtgttgaagattattacctttatgattattgggtgaaaatagtatcattttgaggtcattcatataacttgaagactgggaatgacagacattttcctgttttgtttcttttctttttactttatctgaagagtctactagaatgcagtgttgctgcctgagcagcagggcattagctttgtaaaagctctgttccttggcaaccccaccactaatatgaagtgcagaacatttgaattgtctttgaccagcttcagcatcagcactattttttttttttgctagacccctagtaggtatttaaaagtacagaaatagaatttaatcatgctttttaccaaatgtgctatgctcttagagattctttcaacgtgcataaaaattctgcagtttcaccacataccagtaaaagaaactcagtcactcatttagccatttagtaaaaagaacaaattaactgatgagcatagtggagacctcaaaggtaaagaagacaatgtccctgaaataaagacaatcataaattttcaatcaaaataatgaaatttaggctgggcatggtggctcatgcctatgatcctagcactttggaaggctaaggtgggaggattgtttgaggccaggagttcaagaccagcctcagcaaaaaagtgagaccctgtctccacaaaaaaattttaaaaattatctgggtgtggtggtatgcaccggtggtctcagctactcaagaggctgaggtggaggatcaccagagctcaggggttggagactacagtgagctatgattgtaccactgcactcaaacttgcatgacagaatgagtccttgtctctaataataacaaaatttaatttttatagactgtgaaaaaccattatgtagatacagttcaagtacagtatgattttataggatagataacttttgcttgaaaatgtattcccaatttataggatagataacttttgcttgaaaatgtattcacaatagagttagtatttggggcacacctttatccatttaacaaacatgttttgagcactgccaggtagcaacacgttactaggcactagagtgagaaaagattacagttcctgctctcatggatctcatggtctagtcaactggaatgaaaggattacataagtagaggtaaagacacacatgatggaggatggagaatagtcaaaggtctggagaatgaccaggacgtcactgtgagttgtctaattgcactgaagcatggatgaagaattggaaagtcattgtaagaagcctaaaaaggtatctctcagggatgctatgaggttctgaatgttatgtacgctatttgggcttcaacaggcaggcactgagtattcagtataaatttttgagcagggaatccaccagaagaactatgcatctggaggattaatctggaaagattgtgtagaatgttatgcagtgaaagagtctgagatgaaacagttaggagggtgtattaataacataggtgaagtgtaatgaataaccaggctggaggaaaagcaataacgatggaatcaaccgggcaagaagtataacaattaggatcagtaaaatagaatttggattggaggaatgaaaaaaaaagggacaaaacaaagttgaactgctggtatccatactggaaaatacagatgtcattcaaataaataatgtaatgaatataagaaaccagttttaggagtgaagtggatgttggcttgaaaatatttcctttgaggtttcagtcaaatgaaaaggtcctgaaatgctacgtggtagcctaagaaggaagcgttcctagagagaaaaaaattagaaaagatttacatttgataatttaatcttttccttcatacaagctaaattgataagaaagtaaaacctatagttttcaccactcttttacaaatatccctaaccttttagatattcacatgaataattgagaaaaatctaacagatgacttgcttatgtcatttgtctgctttatccttaggttcctctggcttatatattgttcaataaaatacagatcattgatattgtacaatgtactgataatggggagtgaatccatgcttgtgcattcttttttttttttttttttgatttgcagagggcgtgcccagtcaacaagagaggcacaattgtttttatcatcacctcttctcatctaattccatgaaggagagtagtattaccatacaacagataatgagttggaaaacaagaaacctaacctcagaacttaaggcttggggaaaaataaaagagtaatttgtgtttaatgcctgtataacttggcaagagggacatataaggcttagtgatgcccaacatgtgcttagatgtggattgttagttgatgtcttgggggttctgtaatctaagctaaatgctcaaaatcaattaattgatgttagacacagagatctgctttgatccctctttatcgtatttctaggccttcccattctcaagagcctgagaaacgacagctttccttaataacttgttatttgtggtaggagatgaaactttgataaaaacacaattatttttaaatgtctctttttcactctaggctgttgtatgtatttcaaaaagttacttttgaccctttccagaatgagaaagcaatcaagaagattataatatcttgcttagttttctgctcaatttatcaacaaatatttcttaagcaattattaagctgagcagtgctcagcgctgtacttggtgatataggaaatggggaaaagactgtctttaaggcctttataatagtaattacctcaacttgtctgtttcttttccttaccatttcgccaaattcattgatctatcttgttctcaaagcaatcgccatagttatattgtaacacagcattttctagggtgtccccattaagttgagagtgttgacaagaaaatacaagcttatttatcattgtaaaacttgagacacctagtagttaccctaaattaaatatttgttggagtcagtcacactaaagagaacacttactgcattgaacaatttacctacattagacagcatttaaagactatgccacagcaaaggcccatggaattcttgtgaacacagaatagaagtgtattaaggaacaagcttaattctgttctcttaaagcacaacactttctcaaaacatattttgaaatcacctttgaccattttttttaactaataggtgggtgggagttagggtaggaaaacacaagcagcttcatcaaaacgatattctattttcttcaaatttgtggggaatcatacggcctctcaattttctacattatgctaattatgatattaatctctctgccagcaaatgaaaataatacatattagatgtagcaaatgtcaataatgacaaaattagtcatcatgcagatactcagggattcccaaaatatgtttggattatgattgctagctttgagtttgcccagaatcgtttcaataaaaataagggactcaaacacatttggagcaaaactcacatcataaattttagacatagctctgccaataatgctctcagttatattttcagtcctaatatttcctctgagttccagaccagtatcttcaactgtctgattgatactctctccttcatttctgtctccaatgcattaagtcctgtgtatttactttccaaatgccacttggttccatgcacttctctccatttctgccactgactcctcctcaatccaagcgaccatctttcctcactttaactaccatgatatctcctgcttggtctccttacttctattcccgggctcctccaatccattcatcctccagcagagaatgatgactagcaccttccacagtgtctggctaataggaggtatccaatcaataattgacttacagagtgaaaatataggcatggcaaataccagtagagaactacagggttttagaaccaatgacattagatacttccatcaaatatttacagtgtataatcaagttgacttgcacattgtcttatttttgaaaaacaattttgttggctttttctatatgcacacatacatattgtatcaccctctacccgccaaatggcttttgaagaagtatttatgtggctccaaattgataatacctctagagagaagagaaattagaaattttaaaatgacctatgcttcctttcgaatatcacgtcctgagacagtgttttttgagttacgtgcaatatgttccacgatgaaacatttaatgtgttcagaggcatgctagtaatcatgtagaaagaattttatgcctgaagtcacatgttctataaccaggatcacttaataagaaaacaagtacagctgtggacaagatgcctttttatcagggaaaggccaatttgttttctttgcaaatctaagtaaatggagagaaaaacacagcccttaaatgttttctatttgtcctgaagttctcatgaatgagttagaaggcgagaaggattaaataaatccttgaacgtagagagagctaacatttattttagcaaactaaaacctattcgctttgcaaagttctgttctgtactttgtaacaacagttttctttaaaacaagagccaccaattcaaatgcctttacagaatgattgaatgctttcatgccccacctaaaggcattcaaatcattaatcaaacaaagttctaacgccaaaacatgtctgggaccagatttaaaatgtagccctcagtttcagagggcaaaaacttaacatatttatattttcctcactttaggtaacactgtattgaatctctgcttgaaattgaggagcacgtgattttttctttttggcccagggcagcatttcttggaagagaaagaaaaacaacccaagatacccttacaaaacatgtagtacttaaagctctttatgatgaattaattttggtatacacattaatagcagtgataataacaaatctatatatatatatataattgatatgaataagataaatacatcaaaaggaaatttcattacaatttgatattaggtaaatgtcccattaaaataaattgctactgtacataattttccttcagttcattggcaggatgtttgctttggaaaataaacagtctatttctagttttagaaggaattctcattattcttttatagcaaccattatcaggagcagatgggaaattgtaccaagagcatatctactattatacctcacaggaaaaagagagtattaaatgaaatctaacaaggcctgctcctgactctagttcctgtaacaaatgaacacacacatttgtatggtttcagcatttgtattagtaaggtacaataaatgtttactgaaattgaaaaaaaaaaagataacaggagaaagaagaggctaaaaaggtgcattttatttctgatcgttcattgtaaagactgctcctttttaaaataatcaaattttattttatatacagagggtacatgtacaggcttgtcacaggggaatagcgcatgatgctgaggtttggggtacagatctcatcacccaaacagtgagcatagtacctacctgatgagtagtttttcaaccaatgcgcaccctccctccttcccacatctactagtccgcggtatctgttgttcgcatatttacgtccatatatgctctatgtttagctcccacttataagtgagaacatatagtgtttgtttttcctgttcctgcgttaatttgcttatgattatggcctccaactgcatccgtgcttccgcaaaggacatgatttcattctttttatgactatgtagtatttcatggtgtatatgtaccacattttctttatccaatctaccattgtttcacaactagatggattccatgtctttgctattgtgaatagcacaagacaggacctttttatttgactgagttccttgcaaattactaataaaagatctggaggtccttagttaaaagttgaatctgtagtgccgttcaaatttagagatgtattttctgttcaagagaagaaagccctcattcggtcatgcttaatattcagctgtaaagtccaaaacatatgagaatgacacaaatggaaacattttataaatacctatacaaaggaggggcacttagttcccctaggcctcttaaaagtcctctagaaagagggtacttttatgctaactattaaagatgagtaacgaatttgtcctatacaacttaacagtatcgtcaaggaagtagaaagttactcagttttactgggcattggagctaagcttgaaagtgaggaggagaagcggcaggagacggagccgagaaggcagtggggagaagaggaggatggtcctttccatgctccctgttgtactaacatgtttggatattatcttatacttcatatatggactggattcttgtccttctcattctgagctctccttgaccttgattcttacctcctataactttcattctttctttactcaaaaaaaggccatttatttcagccatttttcactgttttcttatccttcctagttgcttttctatactatttttccactcttttttttttctatactattttgcccttctctccattttcctaactgctagatttccccaattttagccatctttcaattgttctgactatcctcaggtgctcccacaaggttatcagaccttccaccaagacggaatccctcagtctatggacaggctaagttgaatgggtcctggtgctgtgcttagcatatgccttgagtatttgtgcatttattttgcttctttacaaaaatccatcatccgatagaagttgaaagaaacttgctgaagcacattaaaatctctgaaaacagtattggctatattttctaataattagcatgactggttaacttgctttatttatcattgaaaaaagtatcagaaactgtatatcaaactcctgaattcttggcactgacgaagagacacaatgagaatgaccttaggataaaaaaacaagataaagcaccatatttgtaggaaattgcaccataaaagtctgtttcacaactctcccaaatttcattttattacatcttttctcttgaccaatcagtaaactcggttaatgatttacctgtctcaaaataattcatgaacaaaattacaagtaaatctcagtattggattcttgaaacatctccttgttcaatgaagtttcctttttcttccctctatttccctgtatttatcttttcttccagttgcattttatctcttctgtttttttatcttgctccctagtttgtgattttttgccaattttttatttcctacataattcatccaatctgtcattgtacaatttcttataactgcttcttagcttattccttttcttcatttgtcacattctatttttcatctattgtgttttcatgcagttttggaaagttttacaaatagacttttaaaaaaatgtacgtaatgttttcatagaaaaggtagtggtttctttttcttatatccttccctgtataaaaataaaaatgtagcagttctttctttgcctatgtttcctctttccttcccccaatttgaccagacttgaaggacttagatatgtaacagtgttattttctataatttaggaacagcttttgacttaaaaagcagaagagaagttgaaaataatatagtaattctacatgtccttcctgcttcccaactctctgcacatgtttgtaacctcccctttcttttttagtgtatctctttcatatacctttgtccccagaaattctgattcagtagacttagaatggaattctgggcttttatattttgaaaagctccccacgggagttagatatgcacttcttattaagaatgaatgcttaatattggaatcaaaacacaataagctttctaactatgatgaataatccaacagatttaattatgattttctttttgtccagaaccaagactagatgttaattgccagagaaatagataagaatgcctatgacagcagtacattaatatgatatcaaagcttggaaattttattggtaatgaataattcagtacttaaaatatttagaagctatagaattaaaattaattaatgttgttcactgtgtgaataaagttgattgagattttacatttaattttgtaaacccagtgttatcttttccagctcagaaaacaccacatacaagctactactttctgttttgatcccttatttttctttcttatgctttatcactgaaaactctccttgagcaggccatgcactgtaaatatttctcctggttgcaaaaccttctcatacaaatgcagtagactgtgtaatgagctcttctttcacaaaattaaaaaaacctgaaagccctgatttgcgattctatacaaatgagatttagatctaacaattttaaattattgcttcactcttagctgttcaattctatctcttatttgggaaaccgaaataataaaaccattgctgattccacaattaggttgtaaaagtcaccgtagccatcagccatgaagcaaaagtgccaagatcaaaactacaaagcaaagaggctgagataaaaatgctgcagcattagtttatagcattataagcagcaataagaattccttgattgcttaacaaagactcaaaaggcatttactccattaccttacaactcaaagaggtattcctggaccagcagtattggcatttttttgaagtttgtaggaaatgcagaattttggtgcctccacggacctaatgcagcagaacttgcagtttagtaagatctccaggagatttgtatgcgcattaaagtctaggaagcaccgctatggtatacatctgatgtgtgcccatgcattttttaaaagtatgaagtaatagttgtaagtattggacactcttgaaggaacaaataagagccatggtctttactctctaaatacctccctgacatctatgttttaggcaaaatttttttcccatttcagtagtcactgatgcttgcacgatgcagtttattccaaaacaatggtgattctcatgtaatagttcatgttgccttaataatttacgttgcctcaagttctctgcccaggccccaatatacaccgagggctgtactcctcccctaacgcctgctctcatacagtggcatagagcccagttttatgctcttggtcacatcatggagattgcacaccacaggctttaacttctgccgtactctcactgcctctaaccctccatatgcctaagttctacgattctttaaattccaaattgacccagaagtctcctccgctcatccttttcactgagatcatccctcttctggcctaccatttgttgatcaccttgctttttttttatcctactgtatgtagtataacaaattatcacttgcaactgtgtcttattttttcaactagattatgtactgcctaagacctagaaaattgtgcttatttatttgaatctctaggaggatcagtaatgggtattaatactaatgactccatggtgatgatgagcctgaacttcctcccttcctttctttctacctctctcctttcctcccttcttttcttcctccattccttcctctcttcctccctccgcttcttccccacttcccttattcatagattcatgcgttcactcagcaaatgcttactgaaaccttccatgcatcagacattgtactaaacaataggaaactatcatgaataagacacaatatctgacctcaaagaatttatgatataaaagtaatggcataaaccgtgattacttttgcaccaacctaatatatagacacagtttgttatgactggtgtctctattactaagcaatgactgtcacatgcaacgctgatctgaacaggtggtaaagagtgagatgtaagcaatggagcaaagccaactagttacaaggaaatatcacatgtttactagagcacatctcatgggcattcaagagagtatggccaggacagcttgtgaatagttcagtaactgtgcatagttttatattcattgtgaggcaccgtgtcaccggtttgctgatttacagagtattttaattgctaactgtatgctaccaaaatttccagtattcgaaaataattttgcttgaatgtagaaaaagaaaaaagccaagaaatgtatgtgaaacgagagtctaagggagctttacctcagtctcagaaaacatgcattccttccttcatttaggaagcatgtactggggtctactgtcagcttgctattgtgtcaaggagtaggagaatacaaaaatattagagaatatgaatcacatctattaggagagttttctacatacgcacattattctgtcagtgacataaggatttgagtcattcagatttaaatacggtaggtacctcaagttctcagatattatttcattttctaaggttcgtatttagttaatatgttattttaatggccttacaaattctagattatcttttttaaaaagttaaatagaacgtaattgccatttttatttaatggtaaaaagcatttttgtttttgtgtgtacttggttgtaatattctccttttcaattgagctatttttctgatactttactcttaaaatttcattcaggaaaaaagtaaacaatatttaagcttgacaatcataaaaatgctctggtgactatagattattttaaaatttattactgtagcttagggatatcttgatgggatgctcctgaaagcaattaattctcagttttttgtggcttctaatgcaaaatacattgacgcagacagaatttgaaatgaattttcttctaatatagcaattaattttatttaaatatctctagagtttttttttaatactgtgactaacctatgtttgttctttttcacctctcgtatccacgatcactaagaaacccaaatactttgttcatgtttaaattttacaacatttcatagactattaaacatggaacatccttgtggggacaagaaatcgaatttgctcttgaaaaggtttccaactaattgatttgtaggacattataacatcctctagctgacaagcttacaaaaataaaaactggagctaaccgagagggtgcttttttccctgacacataaaaggtgtctttctgtcttgtatcctttggatatgggcatgtcagtttcatagggaaattttcacatggagcttttgtatttctttctttgccagtacaactgcatgtggtagcacactgtttaatcttttctcaaataaaaagacatggggcttcatttttgttttgcctttttggtatcttacaggaactccaggatggcattgggcagcggcaaactgttgtcagaacattgaatgcaactggggaagaaataattcagcaatcctcaaaaacagatgccagtattctacaggaaaaattgggaagcctgaatctgcggtggcaggaggtctgcaaacagctgtcagacagaaaaaagaggtagggcgacagatctaataggaatgaaaacattttagcagactttttaagctttctttagaagaatatttcatgagagattataagcagggtgaaaggcactaacattaaagaacctatcaaccattaatcaacagcagtaaagaaattttttatttctttttttcatatactaaaatatatacttgtggctagttagtggttttctgctattttaaacttgaagtttgctttaaaaatcacccatgattgcttaaaggtgaatatcttcaatatattttaacttcaacaagctgaatctcagttgtttttcaagaagattttagaaagcaattataaatgattgttttgtaggaaagacagatctttgcttagttttaaaaatagctatgaatatgactatgaagctaaaaaaagtgatagtgtcacttacctctagtttcaccacatttgtgaatacattcttgaaggggaacttgagccaaagaggtacaagtttaatggggaaaacaaaacctcaaaaaggttactgtcaaattcaatcatcatttaaatttcccttggaatgtattgaaggcacagaaagccaaatgcgtgctgctgcagttggaaagcctagagagtttataaatgggattttgtattatgcttccagttgttgatgttaatgtgtcttgtttcgtaaaggaagacttggcctttatttaccaaatgagactattgttatgaacaatgaaaacttcgttcttttgccaagctcttgcatcccacccatcatccacataataggtggattttaatattcaggaagctagaacaactcattgatgaatatctttcgttaagatgtattaaaaagaagattttggaattatgtcagttgtctttgcccacctcctctttccctctttattcatgttacattattcagaaagtagatacaattcatattttgtacaaaataaacacattagttgacctaaacacacacacacacacacacacacacacacacacacacacacacacacacacacacaccccttgccaaagttaaagaattatagcctcatcaaaagatattttgaataattaagtcttggttttgaaaatcttcttgattatagatagataaaataaagaactaaactttgtagttaaactacttccttaggtaagtcatatacttttttcccagattgaaattcttctcttaatcatacaagtattttattatttagataactgatgtgcttatactatgaacaggtataaacctgtataatgtcatttctgaactaggctcaatctaatccaaattaagatggtaagaaatgagaaaattaaaaaaattgaataccatactataaatatatatatacggagagaattcataaagtggattaaatcgactggaagattatttttctataatatataaagtattgtttcctattttaaatgtcttactcatatagtatttgaatagagtgtattaacattccctctgataactctaattcacctgaattttcaaaatcttgttatctgttattgggctctaaaggcacattataatttataaacaaagatgtagcaatatgcctgtttcaccaaataagctctaaaattttagatctttctaattttataagaaagtggtatatgctgactctgttgtgaaatagtatacaaattttaagttaattacagctagggatttggctgtaattaggaaaaaaattttcccatttaaacatgttgacctacattaaatattgcacttcagtgctttaaaaagtcaagttcagcttccttgagttttttttttaagctgagcttttaaagttgtctatttcacgctacattttaaaaataaatgttaacatatttaaatttccactgagaccacttttgtggcatacttcctcaggatttttatatcacttaaattttatgaaatgtaaaaatgtaataaaatataagtactggttctaccaatatactcatagctatttctaagcatccagtagcaaatcaagtaaaaattaataaaataatattttatgaataatatgttaacctaacaattaattatagaagggctgtaatcacgaacctattgctaatcaatagtgtactctcagtgcaacgcaagcagatgttagaagggaatagaagttatttattgcaccggtgaaaaatatataagatgcctattcaacttaacaacagtagtcttcgtttgtaatggactttaagtacagcggttagaaatatttaacattttttagtccagggacatcaatgaaagaaagtgtataaattcaagctagatgtctatatggagccctgtagttgcaaaactttaagtcttctgaaattttaagatattagaaataggaaaaaaaatctcaaaagttcaaataatagtggacatccaagaaggttagtctatgttggaagcaaatgaagtgtgaaatgtagtcagttagcgatgcagtttaagatagacaattcactacagcttcaattatgtaacagaagaactggatacatctataggcttaagcatgataataatgagtttaatgatggcgtagccaccaaaactgtctttgtacacgaaggaggtgcaaataaaaacctatcatcggctgtaaggggaagtcataggttgatacaaagcaagcctgtgtacaagtctttaagcaagcgtccatgaatagcaaggggcgccatgctcttcactggagaagaaaattacctatttgtctttactaacctctaactgaaattaagcattccttttcattttgaaagtaggcaaaaaaatcacagtagtacaatcagtacctatgaagtcacagatatgtacacatctcattacagttataataaatatatcaaaatatcatttatgcttatcactacttcaaaactgcagtacttattatatgtgctacagggtcttattgttgggctttaaaacattattctgaggaatgtcaggcttcaacagattgccaaagaagtccaaggcataaaaaaatgatcctagccagctgtctgtttatctgcccagaatctcatcctaatttactatggtttcagtcattttaatgtgcagtcactatcttcatacactccttttcttctggagtattctaggagaagacataccagtcgaggggttctggggagccaggccttcaagcaatggattgctgacaacataatgaagaggattttacttagaataatgtcagttgataaaagtttgaatgggagacggaagcaaggcagtgggaagtggaattcctaaattgaggaacctctgaatcataatccttagcaataataattaagatttcaaaacattataattctttcttcttttagacaagtctgatattgcttatcccatatcacagataaggcaattattctactaatatgcattaaggaatagtggttttaatttaagtgttaccttaatgaaaataattttgaattttttccttccccaagtctttttgtgaaaaatttcaaacatatagaaaaattgaaacaattgcaaaacatatgcccatttacactgttttcctccccctaaattcttagagtcaacaattgttaacattttgccatatatgctttttttctctcgctttctctaccctctttctgtatctctcatatatagggcatcacacacacacacacacacacacacacacactttttaacatttttgcaaataagttataaataccattatattttacccctaaataattcagcatgtgtcgctttgaaatacagacatgccatatataaccatgcctgtttattatgctctcctccaaattaaatataatactgcattattgttaatatccattccatattcatatttccttaatagttcaaaaatgtcttttatattttgcaggggagttagtaccaatatcttatcatggctcatgcattacatttggttattattatttttcatccttcttagtctaaaatagcccttccacatttttttcaccgatattgaaatttgaaaatgtccaggacgctagcctcaaaaaatgtctcatctttcaggatttgttttattttttttcccctgatgggatgatttaacttgttctgtagtctctgaatttctagtaaactggaagttaggtctaaataagacttcaagagatgcatgtcaaacatgtttggcgagaatacttcatatgagatgctgtgtattttgtattacgtcacatcaggaggtgcatcatatgaagtagtctcactaaatgctgcaaagttttattacttgcttcaggtggtgactgacagatcttgcattataatgtcacattttttcttcgcaattaataaatcatctaatggctttagtatccattgatgatccttccctaactcagttattacactggggcttgcaaaatggaggttttcctaatctgacatgatcttaacatttaccagctggctttcttctgtttgaaaaaaaaaaaaaaaaaaggtttttcctctatatttatgtcaaaatggactcataaatttttatttattcaatatattattatgaattacagttattattcttgcccagagcttcctgctcaattgtcccaggctcaccttggactttgcctatcccagatttagaattacccatttttttcaaggaactctggttacttttagaggtgaatagtacgtagaaacgtacatctgggtagtagccccttctcaatggaatgtgtgcacctttctggcaagcagtcccaaaggagataatattttcagattaccttggaaatgattcttgacaaatctctttcagaatacatggaagttaaaagtaagtctagacatgttaaaaagcccttcttgtgtgagacttcatgtacggtcattaagttactactcctttaaacctctctacttctgaattcttaaaccaaaatgtactagtatataatctatgctggtttgccatgcaaattaatggtgtaaataagataatgggaggcattcgtaaatgtacttaaaggaagaaattattgtttaaagaccttagctcattgtttgcatgcaaatacacgctgttgattagaaatgagccttatctaattcattaaagtaggcctggttggtcctcttcttgaaagtctccattagcaattcatattgctctatgcgcttccttgtaagacaactgttgtctcttaagttttctttaactttggcttcttacaaattcagaccccacccccaaccaaatagctttcaaccaaatagcttttcagcatcttatttcctacaaattaaaagcgaatattttaatgactcaaatggctctttacagtgtgtgcaatatgttaaatgtacccagtatatccgtgtgaaccagtgctacaagcctgctcacacattcacattttgcccccaggatctgtcccgtccgcttgctctgtactcaaacttcctttttttctcattgccagtttagaccttgactctccatccagcccagagtttggaaactgagtacccacaggctgaatcctgaatgcatgcagtatttttgcatagccactgtttttaaataattgacaacttttaaaaattgagagacctcattttttaaaaaaatatggatttctgtcttcttttgaaaatttagatctggctactaggcactcattactatattttctcttggcaccatcacctacaactgagtaacagatgtttcattttcttgctactcaaagtgtggtctctggtccagagcacagacatcacctgggagttgctaagaaatgcagaatctaataaataacagtcagcatttttaataagatttccaagtttccaagtgattcatgggcacattaaagtttgagaagcattgcctggggtaagcaagctttgtcctcagtttgcagcacctgtcccactttgctcatttatattaattgcttttccatagatatttgattttatagtacctcatgcagacctttgtatgatgatgacggttagggtggtgatggaagtgatggtgataacacttaatattgccatgcactgttccaagtgttttacgtagctcaatacttataacaactctatgaaatagttgctattctccttttaattttacaggagggcaacgaaggcacagactgataaaactctttgcccaagattgcacagccagcaagtatttgaaccaggatgcagtcccgcagtctgcctccggagtccttactctagatcagattttgcattatttatcccagttttgtccatcaggattctctggtatacacttgcaatttcttcctaccaaccttctccttacctttgatggccacacgtagtagcaaaagaattgaacatagaatctgttctgacctatctttccaaccctgtttttcataatttccactatttctgtttatgtctgaagctttgaatgacctgaagttttctgttcttcagcttttgcaaaaaaaaaaaaacaaagaacaaaaaacaagacaaaaaaaaaaaaaaaccgcttcctttggttgaattctctttccccttattttttttcccaaaatcttacacatcccttaagactcatcttaactgctattacctcaatgaattgtgacctgctcttctcaaacataagcagtttattctcttaaggttttcttgcccctttttataacactcatgtaatattgtatgtatatatcatgtatcatacctatttacatatgcttttcccccagcaagattaaaagcttcatgagggcagaggactctcttattgttatctctataacccacagtacttaccagaaagcctgatatattgtagatggccagtaagtactttcttaatttaaatcgtaagaattttattcacattcagattaaactgaagatttaaatctttacacttgacattattatatagattaaaaatagatctaaagagccagaccaatttttctgtttttatcatgttatcacatttccatggatacgtttgcaattctagaaattgaccttgatcccttctagtcttaaaaaaatggaaggagtttggttaataatattttaggtattcttcagaatttagtacatttaagagacaagtaacttcaatttatttagctagttatggcaaaaagcagctctttgattcaaacattttgtacatttgtttatcctactctcactgtatctcaactaataccttttaagtgaattaagcaggaattagccctgaaactgaatgttttagcctcatcctacatatagccacaagatgttttagatgcaatccatatcaccaaagagctatttttagattgatcagagagaatcatacagatattattattcacaggtgtcaatggaaaagctggtctcttcccatctgttctctgatgactcttgaaaagctttcaagggcattcataattcttcatcaaaagactatgaaaaatcagcttcatagttaattgttttatgtcatattttattttttcaacttggctagttctagtgaaacagactagctggcaccaaatatgttgttgcattggctggtaatgatgataccactgtgtggagatatacaagtgaatgtactttatttgtggccttccatgaactttatgtgcctgggaaagtaggagttagggagagtttgttagggaacgtgatctctgggatgggtcttaaaggatgagaagaggcaaatgaagagtaaatggacatgccagagagaaaaagtgacaggagcaaaatcactgaagcaagaaaaaatggcctacattgaaggactatacacagttcagtataaaaaggctctgttaagcaagcaccattgacttaccctaaactcttcattttctacatataaactgcccaattcccactccaaacctattgatggatattagtaacctattgatgtttttgaaaggtgttcaagtatcctttctggtaccatgtaccttggctcccaccatttgagagtatgttctccaagaggcaacagtctgtggttcctgacctggctatgcaagttattcttattattaaaattgtcctatttaattaaatatcatgaaaactaatgaaatagaaatgaaaagataagagaattgtggtttctatgaatactaaattgaatgctttggaagacttgataaaggtgattagaaaaaaaaaaaaggccagatgcggtggctcacacctataatcccagcactttgggaggccgagatgggtggatcacctgaggtcaggatttcgagaccagcctggccaacatggcgaaaccacatcgctactaagaaaatacaaaacttagccagacgtgggcctgtagtcccagctacatgggagtctgaggtgggagagttgctcgaacccgggaggcggaggttgcagtgagacaagatcatgccattgcactccagcctgggtgacagagtgaggaaaaaaaaaaaaaaaaaaaaaaccacggtgctgttgaattagatgtaggtaagacaactgtttaagattgggtatgagggatagaatccccaaaaaatggaggtattttgcattgagattattttcagcatctccaaatctgactgtaattcaaagaaaccaaactaaaagtcacagattatgaaatgtagaagtgttttatgcaaaaagtaatatgcttaacttcaacctgtgggcttttactccaggaaaagtctcggaccccataccaaatgagaagtaaatgagtgaccacttgtatattctaagaaaaataaaatgtttgaagatgtgtaaacacatttatataatccctccaattttacaatatttttccaaaaaccgcctatccacttaccctaatcaagtttgataaggggacttccttttatatgtaggaaggctgaaaaatgacgccatgacaaatgaaattgtcaagatggaccaggtcatggaagatttgaaatctcaaagaattttttccagggtagaatataaggatgttgggacgtttttatatgctttagatttgcatcctcatatgtccctttgacagttgagctcagagtgaaaaaaagagagtgaaactagtggcagggtgactcaagttagagacaatgagtaagcagaatagaactttaaaaacctgacagattcaagaaatacttgatgaaagtggaacaatttagtcgttaagtagatgggatgatgaggggaatgaagggacaattctaggatgatcccttttccaggttttttgcttgggggaactggctgcatggaaggctgttagtcaggataggaaatacaaaggagagtaactgaatggaaagaggaaagcaaatcagacatacagagctcaacttgggatataatagtcttaaggagctcttggaacattgaaaataaggtgatcagaaaacacgcatttgaataggtaagtctgaacatcaggaggaagacaagggctgaagacactgagccattttgctgtcaatgtagagatggtggcaatctccattgaactaactgcttctcaataaggtacctttctcaagtcattaatttgctaaccagtaaacaaaccagaattcccagagtacacattaaccattaagcactgctgtggaaaaggagttcaggtgtcaggaagccaacgtggcagatgagcactagtggtgacaaatgaaccaaagtgatatgggtgatctttatggggccacagagtaccactgtaaactatcacaaatcagaagggttgacaaacaaaatattggggataaatcagggaaaacctaccacaacatacaggaaaataagttcaaagatttcatcctacagattgcagataagaaatgagccctttttatttggggcaccctagggaaagagtagatgcccatatgtatatttaaagtatgaatacagcatttatttgaatatactgcaaatggtcaatacaagggtagctacagagcccataacatgaaaaggaaacacaaagaaatacatgccccagtcagactccttacttgggttgctgtaaattctctctccctttaaggttattgcatttaaagtctatctgttgattggacccaacagcagctgcaccaagactgtaccatttttaaaaaaaaaaaaaaaaaaaaaaaacaggccaaatggcattctgcatttattttccttgttgctgaagaaacttgaattgtctaccctcaaagcctgtcctttgagacacattttataattagaaacacttatttacaaagttctttttatgttagaatcacaaatcataacactccaaaaaaggaatacactatcctcaggtgagtgtcctacctttgtttacaaaagaaaacccaaagtcctaagagaaaaatgtgttgatcattttattgattccttaccttggtttaatatagttaatggatgtcttagatatgtataataagtctattatcatgttccctttaaaattctcttttgttttactaattatatgttgtcatagtttgaccattaatataagtctaaatttattataatgtgattttttctacaaaggttaatttgaattaaaatattttattttatctctctctactatgataaatgtttttaaaaatcgtttgtaaaatgaaagtactatatttgtgtaagctgccaatctaacaatttatcatttaccattatgatggtgaatgtataacaatccttatattcagcagaaagccttatctctcatttcagaggaatcttgccccggttaattattctgtctcttgaatgcacacaaacacaagcatatctttaccctttttctgctgcctcactatccctgatcaggtgaatgtttttagctcctagattacaatataaatatattcagacattcctttccaaatgcattcattccactgtacttgtcagagttcatagctgtgaataacagaacccagtttttgttgatagaagcggaaacggactttaggagaaagatacagacctgttcccattcctaaacaaagggatagaaaaccagctcaaaatgggcagaactcaaaaaagaggctcagctccaagaactatagtccaaatcataccctagattggatctcgaactcttggactcaagcgatccactcatcttagcctcccacagtgctgggattacaggcatgtgccacgacgtctggcccccatacactagatgtaaacgttgccatgcaccactctaccactgcagacactgggtgaagaatgtcattgctactggaaagaattctagatagtgccttataattctgtcactcattccagattcaaaaactgaacttcccccatcagattccatttgtatttggggattttgttcgacataatcagggcattcagattctgggcaaccaaagttaacaaatgtctcttacttcccctttcttgttattattcccatttgaatcttcttcatagttagtcactgttacttaaacacacattctctattatcacatttccctctcctctcttttgctgtttgcttttgatccaaaccactgctcagaaaccattattgccaataacaacaatgatttcttgtagttaaatccactggacatatcttagtcctattatccgtaggccatgtgccattaactgaacactttccgtattagcacttggtcctatcttatcttccaagtcactaatcttatctgaatttattcttacctctctatgtaattccttactatattgatgacactccttgctttacctgccccttacatcctgatgtttctctaggacatgttctgaaccctcccttcttctcattctatacggtttccctgattgttatccatagcaacaaatgtagctttcactgtatcaattagaataatatctagggagattaaaaaagaattatagtaactgaaacaaagtagaaatatattcatcttcttgtagaaggaatctgccagtaggtagtccgaggttggtatcattgctctatgatgttgaagatccagatcccttctgtctcacagatctgccatcctttggtgaggtccttacactcatggatcaagatgactatcagctctctatctatcacaactgcttttcaaaggctgcaaggtgtaggaagtggacaaaaaagggatacctctacccttttaaagggacttcatggaagatctacacaacactttagcttgtatgtcattggccagaatttattctcatgacaatgccaaactgcaatgggcattcaaaatgtagtggaatggatcatgggctaagcagctaagcagtctctaccaaagtcaccgatttcattttatggcctaagtctaatatttggcccaatatatagtttcagattagacctacatatgtagcttcaaatggaccatttcctcttctatgtctcaaagccatctcaaagtcagtatatccaaaactcaacatgttatattcctctcccaaaatctactgtgggtgatatcactatctattcatgtacccaaactataaatttggaagttacaagagctagtattaatgacactaagttttgtgcatttactctatgaacaggactttgataagagttttacaaatgtttcccacttaattgtcgcaatatctcagttatagagattttatacgtccatcatctcacctgactcttcgagatcataagcaaagcatggcagcattcttatgtccattttacaaattaccacattaagcacaagaaaaaacaagatatatgtccaaggctaaccaaagttatagaaggatcgagaactaaaagtcagtgatttagacccagatctgtgccttttcccttattgttacatatgaccatatctagctatgtgaacaaagcagctaatagtgacgacagggtagaacaaataagaaagtgaatattccccactacatttatgattatttgccagtttaacagcttcaagcctgtgtcttctcagatatgtgcttcctcttatgtctaaggaaaagtactatatttgatatgcttttatgaactttcttttttgagatggggttctggctctgtcactcaggctggaatgcagtggcatgatcacagttcactgcagccttgatctcccaggttcaagcgatcctccaacctcagcctcctgagtagctgggaccacagacacgggctactacacccagctatttcttttttttttttttttttttggtagaggcaggatttcactgtgttgcccacctggtctcaaactcctgaggtcaagtgatccacccacctcagcctcccaaagtgcggggattacaggcatgagccaatgtgattggcctgaattttttaaatttaattttattgaggtaaaatatacctctatataaataaaagtaaatatacctttaccatttttaagtatacagttcagtggtaataagtaaatttatgttatttttcccctttgtcccctctccctactcctatttctgatctctggtaaccaccaaggtagtgtctactttcatgagatccatgtttttagctcccacatgtgagtgacaacacataatatttgtctttctgtgcctggtttaccttacttaaaataattacctccagttctatccacgttgctgcaaatgacaggatttcaccctttgtatggctgaataatatcccatggtgcatatatatatatcacattttctttatccattcatcctataaattttaaatggtgtggaatttggagaatacttaaggaaaaatgacgattgtgtaaaaggaaagtatctacaaaagcaaggtttatctaccccataaagataacaagagaatctgtgaatgtggatacggtttctggagtgtttcagaggttgaaagattgtgaagaactggatgggtataaaaaaaagtgaggaggagaagaaatgaaagttctggaatgttctgtaaattgtagatgagttccctatattaattttaaaatgtaaattgagattataattattttttgatgatctatttttgctgggctgattctctgttggtgtaactctttaacgaatatgggtcacgtgggaccctggattttattagaattacatgtgcgaatcaaattctaactttatgagccaatataatgattgtttttttaatgattagagtctatccatgacaaaaacagcttgtttctcctactgacttatttggtgttttcttgctaattagcctttatactaggcagtagtaaatcagagtacttggacttcaggttggccattacataaacctggcaactaaatgctgggtaataatcacctatcttcccacctgtgtttattacctttggaagtatgtaacatggtatctttgcgtttatatttttaatttgttcttttttctcttgcaccagctacttaaattatctgagcttccttttactaatccaaaaataaagataatagtacatatttatagagatgttgtaagagtaagaggtaatgtaaataaattggctagctctatgcccagcacatgagtaggtgcttagaagttagtgtctgggtacatgacttctggggatgataaagtgagtagctcgataaatctccccaagaatcagtaaaatgggacacactggagaaaacatcttatgaccctggatatcaaccaacggcatatgctaaattaaaaagtgattatttataaaaagtactaaactttgtatatgaacaatatgaatttgtggtgtatttgcctgtattgcccccagtccccactcccagcttggtcaagcataatagttctatcaaggtagaacaagccatggaaataagcagcttcatcaccacagggactgattttatttgaagcagaagtttaaaactccatgtccagaagcattgtcagtaacggtggagacctaggcggcaaacaaaaaggcagaatagcaactcagctggcctaaagttgcagtcttgattggaacaagtaactgactggcagactggccagaaatttaatttaaccagcatatctgcaaaatgaggcagccgtaataggcctcagtaaggactccttgtgtctccttcatgaaaacttaaaatgtgcctgcatgttgaatataccctttaacacatataaagaacctttagcaaaacttggaagtcttactggcttgaggtatttaagatcaactgctggccaactattgactaatgcaaattaagctatgcttacctctaggaaactaggcatacagtttgtttctgttgtttgacagagaaagaatatcaacagccacacactgtggggaaacagattccacagatttcatctaggcaagttattaaaacttcaatttaaaaaacgctgggcataagaaggaacatcagaatttggggctcctttaatatgttatttaaaatgtcaaattttcaagaaaaatttacgatacgttcaactgtgacccattctcatggggaaaagcagtcaacaaaagttgtctctgaattggcccaggtattggcagatagagacttaaaggctcctactataaataccttcaaacaactgaagaaaagcatgtttaaataattaaatgaaagtatggtaacaataactacaaatagagaatctcaactaaaagatacacactatataaaagaaccaaatgaaaattctagaattggaaagtagaataaccaaaatttaaaaaaatcactaatggggctcaagagcagatagtaagacagaaaaaaaaaaaaatcagtaaatttgaaaatagataaataaaaattatccaatctgaatgtcagaggtaaaacagtataaaaaacgaacatgagtcatagctttgtgtcaaaacattgagcatatcaatgtagatgttacaagagttccagaaaaaaagagaatgttgttaaagaggcagaaaaattatttgaagaaataatggccaaacacttcacaaatacggttaagctcaacaaaccccaaatagaataaacacgaagagatcaataccctaaaacataagagtcaaactattgaaatagtttcatttgaaattattgaaagacaaatgggaaagtctttaaaacaaccagaaaaaaatgactcctcatgtacagggatcacatgattgatagttaatttctcatcataaacaatagaggccagaggtattgaaatgacatattcagagttctcagagaacacaaaattgccaaccaagaattccgcataaaacaaaactatccttcaaaaatataggtaaaataaatatattaccaagttgagaatgagaatatttcttgctagctgacctgacttacaagaaaaaactaaataaagtcattcaggctgaaaagaagtgatattcagtaactcgaacccaaatgaagagataaagaatcacagaactgataaatatgtagatacatataaaagactgtacaaatatagatatatgtttttcttcttttaacttctttaaaagacctaagattgcataaaaattataacattgtgttattgtgtttataagcaggaggagcaaaaatggagcttagcagagaaaaatatctaaattttactgtgttaaattagtttgaacttaagtaaattatgatcaattaagatgcatatgtaatctttagagcaagcactaagaaaataaatagttaaaaacaaaatttaaaattacacactaaaaataactaacaagacagtgcagtaaaggagaaacaggaacaaaaaagacatgaataagatgtgaaaaaatacaatatggcacatgtaattgcaactaaaagttgagaattcccattaaaaaaatctgaaatttgaaatgctctaaaatgtgaaactttctgaaggttgatataataccacaagtggaaaatttcacacctgacctgtaatgagtcacagtcaaaacacagccaaaactttgtttcatgcaaaaaattatttaagatactttataaaattacctccaggttatatgtataagatatctattaagatatatatatatacatatatatatatatacatatatatatatatacacatatatatatatatatatgtatatatatagtatgtgtgtttaaacttaggtcctatctccaagatattaggtatatgcaaatattacaaaatctaaagaaatccaaaatccaaaacacttccaatcccaagcattttggatatgggatactcaacctacatatcaatagttatagtaaatgggagtgaactaagcattccaattataggcagagatttcagacaggattatttaaaatatccaaccatagtttgtttaaaagagaaatgtattagagccaaaaccatataatttcaaagaaaaaagaggtactatgcaaattgtttacatataaaaaatgaagtgacaatactaatgtcagacaaaatagactttatgacaaaatatgtaacaagagaaaaagacatttttaattatataaggggtcaattaagcagaaaatataacaattataaacgtatataattaataggaaagtcccaaattctatgatgcagaaattgacagaattcaaaggagaactagacaattcaacaattattattggagacttcaaaccctactctcaatagctggcaggccaattagacagaaaaatagcaacaatatagaagaattcaccaacactatcaaccagcttgacctaactaacatttataggagacgccaccaaatgaaagcagaatacatattattttaaagtgcacatgaaattttctctgggatagattctatgctaggtcaaaaaacaaatctcaatacactcaacaggcttgaattcataaaaattatgttctcttaatatgtcagaattaaattggaattcaacagaaggaaatttggaagatatcaaaatattttgaaattcaacaacttctaaatccattggttaaaaactaaatcacataggaaattataaaatattttgaactgaataaaaataaaagcacaacatgtcaagatttataggatgtaactaaagcagtgcttacagggaaacttctagttttaaatacctattttagaaaagaataaaattcttaaatcattaactcaagctttcgccataagaaactagaaaaagaagaacacagtaagctcgaaggaagcataaggaaggaaataacgggggttagagcagaagtcaataaaatagaagaagaagaaagaaaaatcaatgaaaccatacattaatctttgaaaatattttttacatggagaagctttagctagactgaccaaaaaaaaaagaattaccaaaatcataaaggaaaaaggggtaattactaccaaccctacagaaattagaaagactagaatgtaataacatgaacaacattgtcaacaatttctgcaaaacatattaaatgaaaaaattcttagaaagacataaattaacaaaactgattcaagaaaaaaatagacatatgaatagacctaacacaaacacagaaactgaattagtaatttaaaattttccaacaaaaaaacccaggtccaggagaaagataggaatccgaggcatccacagtatagaagaagaaatgaaactctctttattcacagacaatacaatcctgtatgtagaaaaatctgatatccacaaaataactgctagatctgataagttcatgaagcttgcaagataatcaatatacaagaataaattacattcctgtgtactagcaataaaaaattgaaaatgatactaagaaaataatttcattctttgtagcataaaatagattaaatggtcataaatttgaaaatataagtactaaacctgtactctgaaaactgtaatacattgctgagagaaattaaaaatctaaataaatgggaccatattccatgttcatgaattggaagactcaatactgataaggtagtgattctccccaacttgttctatagatttaatgcaatctccatcgacatcttagcagatgttggcacaaattgaaaaattgcacaatcttggcacaaattgaaaaattgatcccacaatttatatatagcaattcaaatgtaccaaatagccaaaacaattgtgaaaaagaagaaaaaagttagaggactttgaaatcaggacattacctgatttcaaatcttgatgtaaatctgcaatgatgaagacagtgtggtactgtcataaggacaggcttatagatcacctgtaggtttaggaaacaaacctattcatatttttttcttaaatctactaactgcactcctaatgttgacaatggaagagactcgatagtccagcaataaactcttatatttatggtcaatcaatatatgacaaaggtgacaagataatccaatagaagaaaagcttattattgggtagcttattgttagtgtacagaaacagagctgattgttaatacaactcaacaggaaaaaggcaaataacttgatttttaaaatatttaaatatatatttctccaaagaagacatagaaatggccaacaggtatgtgaaaaggtgctcagcatcactagtcatcagggaaatgcaaatcaaaacctctgtgagatgaacactatcatctcacccctgttaggatggctactataaaaacaaaccaaaaacaagagataagaaatgttgttgaggatgtgaggaaatcggaacgctagtacaccataggtggtaatggaaaaatgatgcagctgctatagaacacagtagaaaggttcttgaaaaagttaaaaatagaactaccatatgatccagcaacctcactcctgggtatatatcccaaagaattaaaaccagaatctcaaaaagatatctgcactctcatcttctctgaagcattattcacagtagccaagatatcaatacagcatagctgtgcatggaagaatgcatggataaagaaaatgtggtgtattcatacagggaatattatttggccttaaaagggaaggacgtcctgccatatttgacaatatgtatgaacctggaaggcattatgctaagtgaaataagccagtcaccaaagggcaaatactgaatgattccatttatatgaggtgtctgagacagtcaaactcgtagaaccagagagtagaatgatagtaaccaggggctgggcgaagggggaactgggagttgctgttcaatgagtataaagtttcagttatataatgtaaataagttctaaagatctgctgtacaacatagtgcctgtactgtgcacttaaattattattaagaggatatgtcttaagtgttcctaccataagaagaagaagaagaaggagaaggagaaagtgaagaagaagaaagaaaaaatgaagggggcatgagcaaacttttggagttgatgcatatacttggttaccttgattatggggatggtttcatggttgtatgcttatatcccaattcatcacattgtatacagatgctcctcaccttaggatgggattgtgtcctgataaacccatcataaattgaaaatgttatgagtcaaaagtacattttcaattaatgatattttcaacttacagtgagtatatccagatataaccccatcctcagtccaggattatactaaatgtgtatcgcttttgcaccatggtgaacttcaaaattgtaagtcaaaccatcgtagtcagtcggggaagatctgtttgttaattatggacccatcgtgtacaccttaaatacttaataaagctgttaaatgaaaattaaaagttgactgggcacatggctcatgcctgtcatctcagtgctttgggaggccaaggcaagaggattgcttgaggccaggagttcaagaccagcttgggcacatagcaacattccatctctacataaaattaaaaatgtagccgactgtggtgatgcaagcctgtagtcctagatgctcgggaggctgagttgggagaatttcttgagcccaggagttggaggttacagtgagctataatcatgctaccacaccccaggagaccctgtctcaaaataaataaatagaagctttaaaaaatattggtatctcagtgttcctcattatccactgtatttaaggtttagctacttgtgcttgatgcttgacaaggtaatcttacttttctccctgatattggtatgatgcaaatttactatatatatgacacaaatttatatatgcaatattttctcgttaatggccttttattttactctcattttcattatgctttgccttttaagtcatatagcaaataaattatgtggcattttcttagcaactattaattcaggagaatgggaacagaattctctcatagattcagctggaaggtaatgatggtcagctcccagtggagaaaaaaaaaaaaactcccttcagttttcgtaaacatacagagaaattttctcctaagtgctatgtcagtctgctgtatgtcctattgatctgagaaccagaaaacacatattttagtttacactgccttgactctattgtacatggctaggtctgtttaaaaaagaaatccttgaagataccctttggattctagtattttaaaacggatgcttagctaagtgaagtggtctacttcaaggatcaaaaccaatcttgagtaatctgttaggtagactccctaagttcatctgtaccttgtaccaaatttttaatgaatttagtaattgacatggatgtaaaataaataatacactaataaagttcatgcagaatcaaattttaatgcccagaggtaatgtagaagatattacctgtccatttctctggacttagctcctgcaactctccatttttctctctaaactttagccacactgaattcctagtttcaattcctctgactcgctaagtatttcttctaccttgataaaagctaattcctttgtcttgtaccatctgtattccggctgatattgacatagttttcagggctcaatttcaatgttacttactcagagggactcactgttacaaccaccacagccttttcaatctaagtaagatccactgctcttcttagaaacaggttatattccaaatgactgtaagtgcttttgttcttagaacatatgtctccattcaaaagaccgatagatattcagttaagccctttgagaaaattataaatgttgaggaccttgattattattgttattattgcttcttttctatgttttcccaggactctcaacaaatttgctttgcttttgtactcatggcacataatgagattaataatgtttagaaaacatttcaaaaatacacacagaggagacacatcttagtctaaagttagacatgataccaaaaactataataactatagctgaccagtgaccccatttattcatggaaagtaaaatttgatgcatatttgcctttaggagcaacatacctatgaaagttctgaaagtgaaagtttgtaaaaaaggagtactctcctaacaatcttaatttttttctatatatatgtatggtttgcattaaactcttttgtatgattagtggtttaatgttgatgtcacccatgacaccataagctacgtgtatggactggctctgttttgttcactcctgaatatccagcaaaaatagtatagtgcctggcccttggtagatgtgtaataaatgtttggtgaatgcatagctacacttcaatgcttatcgcattttaatcccagctactcggaggctgaggcaggagaatcgtttgaacccaggaggtggaggttgctgtgagccaagatcgcgccactgcaccccagcctgggtgacagagcgagactccatctcaaaaaataaaaacaataaaaaaaaggagacccattcatgtatctgtatcactgactagcctgtcaacattttgttaactacctcatcaagtagcaaaatcagtacctggtatgtggtagatgctcaaatatttgttgataaaatacagtaagttaatgacaggcgagcttgcctcagtgaaatataatctgtaagtgagcagtgtgtatatcatttgaaggtgccctacttagcctagcatatcacagagattcccagtaaatatttaggcagttcattaactctaaaagttgaccctcatagtcattggcctacattattcacctccctctgtctctaataaattcattggcaaatttctgaactccaactggaatgtttgtggtggatttcttcatacctaatggattatttcaattttcattttacattgtattatttacttgtctgaggtctttataatgacaaactcggcatgcatgataagctgtcattacttatgccagttgacaaggacatattatttttctacaaaaaaaattatcttggccaggcgcggtgcctcacgcctgtaatcccagcactctgggaggccgaggcgggcggatcacgaggtcaagagatcgagaccatcctggtgaacatggtgaaaccctgtctctgttaaaaatacaaaaaaaaaaaaaaaaaagcagaacaaaacaaaacaaacaaacaggagtggtggcgggcgcctgtagtcccagctactcgggaggctgaagcagaagaattgctcgaacccgggaggcagaggttgcagtgagccgagatcgcaccactgcactccagccgggcgacagagtgagactccgtctcaaaaaaaaaaaaaaaagtggtaattgttcaaaatatttacttattaattcattttaaaattgcatgttgaaataaaaaataaatgtttagtttttaaactatctcttctacaacagaaacaatatagtgagaagagtgatcttgttttacatttttgcaaatctctttaaaagttagcttaagagaaggcagctggttcttatatctgtttctgcattgaatgtgctgtcatatctcgcatcatgtagcctctgaaaaactcataatagaatgagagaggaaaaagtcaaataacatcttagtattattacgaaaataatttggacctcacagaaccactgcatgggtctcagggactcccaggggtccccagaccacatttaaggaaatactgtttcagggaatataactatttttgtacctcctgtggctatattcttttaaagaatagtaacctctgtttctgaggaacttagctgcaattatgtgcagagtttaaataagtgaaacggaaataccctttgcctttctgctcgagtatgaaagtgatgatcaaaatgttcccttttctctctctctctctctctctctctctctctctctctctctctctctctcactctctggggaacttcgggtttccgtctctatataatgtattcatattccactggaaacatacatagtttgagaaaacagatgacattttttctgggggtggaaagaattactaccacgaggaattcaaaatacagacacagtaataaaaatcaccataaagcccagaggggaaaaaaattgagtaacaaaataggaggtgaaattataaaactgagtaacaaaaaagaggtgaaattataaaataaatgataaagttggttgtgggttaggaagaaagagaaatataaagaaactggcataatgtaaaagccaagacaagaaaagtgaggcagaggcataggtcttttgactattttccatgtttgattctaaggtaagtagatatagtttctcatagttggaaatgttcgtgaatttaaacagaattaatgtttataatcagatgcaatgtctagtttttctatttgtcctgtgaaataataattgtgtaaagtgctcatgattgtttcaaggggtgaggagtagttctaattatcatagatattttcatgacttcgcataccactggtttatagagattatacagattttcttatatcagaactctcgtatctttaattccctagtagatgtctaagaaggagatttatcacatagcagatggtggtaaacttgagtaaagtgccagatactaaatgcctttggctttgtgggccattcaatctttgctgcaactactcaactctgctattgtagcatgaaagtaaccatagacaatatgtaaatgaatgagtgtagctctgttccagtaaaactttatttacaaaaacaggtggtgagcacaacttggttcatgagccatagtttacaaacacttgctgtatagctttccctggttgaatttcgttaattttatacagaacctgcctcccatacacacacactttgttcttcatggaaaatctccccagactactatgaaataatgttattacttggagatatacaattaagatgatgtcattaggagattattaatataggaactaagcaaatactatatgctaagtactgaggatagggtgcgatcacaatagatagaaaatctgcaatagtttgatgaacatgggaaattacagtatttcctgtgatggaaacattatgaggggctgtgggactacataacaggacctgtgacctatacctgggttggggatgtctaattaatcaaggaaagctttgtagaggaagtgatgtctaacctgagattggaaaggtcaacctggagctacctagatgaagatgtatggaaggacatcccaggcagagggaacattgtatgatgaatcctgatatggatatagtgctggattttaaggaagagtaagttgttccatgaactatacagtgcaaagaaagatgaagaaatagaagtagagaccagatcacaaagggctttttgaccatgttagagaagttatattttatcccattggcactaggatgttgttgagtatatgaggacatgatcagcaacatattttagaaagatctcttattctgaagtgtaaagagtggataagaaggagacaaggtaggaggcacgagctaattagaaagcagtctcagagaggctgttagaaatcagaacagaatggctattattaaaaagtcaaaaaacaacagatgatggtgaggcttcagagaaaagggaatgcttatacactgtttatgggaatgtaaatgagtttaggcactgtggagagcagtttgaaaatttctcaaagaacttaaaagagagctgccattcaacccagcaatctcattacttggtatatatttaaaagaacacgaatctttctaccaaagagacacatgtactcacatgttcgtcgcagcactatacagtaacaaagacatggaatcaacctaggtgcccaccagtggtggattgaatgaaataaacgtggtatacatgcaccatggaatactacacagtcataaaaagcatacagtcacgccttttgtaggaacatggatgcagctggaggtcattatcctaagtgaattaatgcaggaacagaaaaccgaagatagttagaagctaaacattgggtactcattataaaggtgaaaacaatagacattggggactactagaagggggaggaaggagaggggcaagggttgaaaaactacctatcgggtactatgctcactacctgtgtgtggtgggatcatttttaccctaaaccttggcatcacacaacatactcaggtaacaaacctgtacgtatactacctggatcaaaaataaaagttgaaatcagaatgagaaggagcgaaggagacagcgacaggaggatggagagaagtgggcagattcaagagagatttctcaagtggacttatgaggacatgcttattgatacgctctgggagtgagggagagagaagaatcaaggatgacttctacactttcagcttaaaaaaccgggagctggtggagtcatccattgaacttgacagaggagcacgtttaggcaggaagatgatggtgtttgaatgtctgcgaagggaaaaactgaactgggattcaaatcagaaaaaacggtttgaagtcataccctcttaattgcattttctatcggatggtaatggctttgtgacaggctttactgataggtgatgtaactctgcctctgacagatgaagatccaaagcatcctcagattttcccgaagcctgtttcagcaactgtgtagacagcacacacaaaaatctggggggaagtcctagggctcagttagttgattggatctattaaagtagcattggagaacacagttcagtctgagatttcccaaacatattgctctataatttatttttacccagaaactgaattcgatgtgggatagggattataaaagccttcagattccagatagaatctctgaatagaaggcttttgggccacatctagtaatctcctttcctcactccatttctgaacttcttgttcacttcttcgctgtttttaggacgttcttactacactcctgcctcaaggcctttgtacttgttttctctgcttagggcgttctttcccgcaatatttgcatggcctcctccctcgcttctttatttctatattacctatctttattaaagctgctataaaaaaaaaaaagcccacacctcagtggcttaacataatagaaactttccgttcatgcaaactttacaaaaattttctggtcaacaagtagatttcctccaaatggtggatcaggggggcccagggcacttcgcttttgtggctctgatgtctttaacatacggatttcaaaatcactgtgctcttgtacataagaatgaaaaagaacaaggaatattacatatgtggtggtggttattggaggtggggttatgagccaggcttcatattcatgagcatcacttttgctcacactccattggctcgaactcagtcatgtagccaaactaatggcaagggagactgggaaatgacagctagctgcacaattaagagaaatgagtagacttgtctaatgagcagctagccagtccctaccacgaggactttgctcaaatgtctccttctccatggaaccttctatgatcaccctttataaaatcacaactgctccccatcttcccctcaatatttccatcccttttccatgcttcatttttttcctctgtaacacttactgtatcacaatctatagattttatttctttatcttgtttactgtctgcctccccttcctcccaatcggatgtaaggtccatgaggcagggattgctgccgatattcacggccatatcaatggacactagtagaccctcaataaatggctgttgcattgtgattacatatatgcttcacctagaagtagtctcatctggtggcacatttactcatagattgacattaattctctattgttttttccccagcaaaatttgtcaaggtagtttgtcagtagggagaaataaagttgtcaggtggctcatcaaaagttcaattttgagtactcctcctgtgtactcataatgttttataaatacttttatctatgtaagcacgtgggcttagacacaattctaggattaaaacagaaagctctgtatccatattttcccttttttgtacctccttttatgttctctaccattttttttgagtgctgttagtgaagcactaggctaaatcttgggtttctgcaaaaaaaactttaatcctcacaacactctaaaatgtttattgttctaattttaagacgaggaaactgagggctaaagagattaaggaactcgcccgtgttcacgtactcagctgataactggcagcatttagatttggacttactttccatacagatattcgcattgctaaccttcaggtttttccctcatcgttttccacatctactcaaaagttgctaatcatttccttaatagtgaggcataaatgactgagaaatcttgatatattatccccctcaggagcacttcattccgacaagacacaaactttagggaaaatgaacaaatgtctacttgtacaactcaagcaccaaccaggtatggtagacatgttggcttaaaaataaagttgatgcttgggttctgattctgataatgacctacggagggtatggcctgaggaggttactaggtgtgtgtagaaatcaatgttttgttttggttttccctcgggaagggtcaacttatacttgaatccttctgaagtttctcaaattacaagatggtcatttattttacttcaatcaaaacaacaaagtactgtccgggaaagatgtattgccttgacttattctcaatttatgcttattttggaggcttgtagaagtaaacctgatagaggagggcaaaaacacacacacacagacacacacacactgggagaaaataaatttaacacagtttagggattgactttggttgtatgacatcacaattgcaagagttggatgccattgtaaacaagctatggaaagaatactgttaaaagtaactcattaagtggttacatggtgtagctcatggacatatggcacagaaaaaagataaagctgtctttacataacataaaactgtattctgttatgtaaatgtgtgcttgtggcttgcagtaaaattcctagtgaaacattacctctagattcagcagtactatacctcaggccacatggatgtaagtaaagatgatgccctctggaaaactgagttaggcaacaacaagtgcatccatgaggatgcaaatttcaatgttgaaggtgcctgtgaagaatttgaacaaaattgttgcatgaaatatgaatgaagaagtgtgatctaatgacataatattttgtactatataattttaaagtagtacacacaatcaaattaatgaattaaacattatatgtaaacaggtgatcattgtatctccattttctaaagtttctatgttaaaggtgatcaaaaaacttggagagagggacttctcatttggaaaatgggatagtcacctttgggtatgtgatgtatcaatctctagaacttcagtttcttcattgaaagcatataaaaggcaatccaaaggatgtatggaatattaaaagattccactgtgaaactatctagcactttacctgaaacacttgttagatcccctcaccaaaatcatgccatgtgatttggcagtctattcctcttagcgtaagagtagcccgacagaaaatgttcattaagagttaatgttaaattcattgaatttagcaacacatgagtagcgcttcctttctgattatgcaaatctctcaccatcgtaatacgtgcttcctttaatttcattgggaacatttgtaatgtaaatggtaacagagccaatatttcaaacagaagccattctttctaaaaaaagctaaatgtctaaatgtattgaaatgcttctaaaagtaaaatatttagcacttatttgcagatgggtaatgttaaatatctcactcattattattactaccacttgtctgaataaatcctcccataagcattaagcaagtaggtaaacaaagaaataacacttcatgtgatgaatgccaatatgaagcacgtttaaactgttctgtcaagagacaagcctggaaatgctaactgtgtttctttgcttttctgcaatcatctgaatacataaattcaaattgcagcttttaaaacttcaaatcgaggcttttgaaatttcagaaaacacatgcgcttggaaaagcagattataacaaggtcccaacgggattttgtcaccatcttttttatatttcaaagtataaaaaaaatctagataagaaatgactaccaaatgttttcatatttaaaagatgctgtttttttaaaaaattaaatcactggaaaaaaagttttccacaaatatcgtgtaaaaagaaagacagcaaaaagcttagccaaagcttttactgtttaagtgatgatttattctgagagttcttaagagttttctaaattagtatatggttaatatccataaaatcatatgcaagatgctgtctttcaaattgatgctgaaggttaattataaaatgtacttaattatttatagtgtcccattgagtcccagatactctgtgtccaagaacactgtaaatacagaaagtttagcagaattatattggaaaggcagtaattcttcacaaattaacttattgatataatgcaatcccatttaaaaattttcagcgagaattgttttataatttgactgaatgatacattacataagttagaataactaaagtgggagagcgggttaacctaccagaaattaaacatattttaaagctgcaataattgacatagtgcattactgtcacaaaaatctacagtagatcaacaagcagaaacttaaaatatcatgaagaaagcaccataaatcaattcagaagagatggtgctgggggaaaaaatatcagtttctgaaaaactcttcaaggttagaaacaacactatataaatttaagatggattaaatatttggttgttcttttttaacaaatgaaagagtaaaggatcaagaataaatgagaatatctgaacaatggtaaaatggccacaattttaaggatactatcaatgaacataatatcaaagaaataaactgttaaattttatttagaaaaaactactaaaaggcaaaaaggaagctggaaacgtagtctcaattaatctatgtttcagataatgtgaaaagagctcttaaaaataggaaaacacaggaaaaatgggcaacagacattgccgataattgacagtggaaactaaataaatgacaaacatgtacacacatacaacattttcaactttcctattagtagaatacttaaaatatctatggcaagctttttatttgttttattggtatatcaattataatgctcaatagtggcaaaagtgtagtgagacaagtattttgtaactgttggtgggagtttacgagtgttctgagtaccaaccttgacagaaattcaacaatgtgtatctaaatccttaggattcccattgttaacttttcattctcattccagcagatacatgattcaaaatgtataaataaatgtgtttattgtagggttattcattataataaaaaatgaaagcaaacaaaattcctaataacacaataatggtgaaatatagggtacccctatatatcttattactaggatcttaaaaaatcaagtttttaaagcgtaattaatgacctacagagacacatagtagaataataaatgaagaaaataagcatacaatatagggtttgaacccagtaatacatataaatctcaactatgatgaataagcacaacatctctcctctgtactggatattcttgatagaaaaaaatatgctagtaaataatttgagacatatttgaaaagaggggagtgtttgatttagaattttctaaacttgagggttattattatttttttggtttgatattactttttcctgctccttaaatttttgtttgtttggggggtttggggttttcttttccttaaacgtgtctgcttctagatgaaagttgaaaatgtttaaaagccttgccaatgtgtctaggtttttcaaatgtaatcagattttagcaagattttacttaactaaaagtattcagaacactgtgcaaaatcatctggagtcaaatagtaatggaggcaatgatttgcagagtagaaacagagagagagaaaaagatgagatagaccctcaaaatctagacccaaggaattaaatctgcttggaacatttaaacaaataaaggatgcctgtactatactagacgttttcttcttccacaattgattctaaggtcagaatctgaggggaaatggtgctgttccacattctaaaacaaactgccagcaatcgagaccagccacttccccatagggtttactctaaagcaacagggattattatctctattccaagcaatttccaatctcctctgtactccgtgtcccaggcaagattaaaaagactcaggtaggaaggggtagtaagctttgtggggagtgcagtttgtggtaagggacagttccttctctttcatctctctgagtcagaagtagagacttcgagagaatcactgagagtaagtatgtagactccaagaaggaaaaagcatcctctcacttcaatgaatgtttggaatctgcagacctccttcccaggtctgtgtagcttttggagaggccagaagagcaccgtaggcattcctttggctttccatggccaagcacatagagtagaagaagaggaggaaccgtaaggttaaccatacataagaaatcaacaaaaggctttgaaattgacttttcctatttttcaatttaaataagagagaattgtcaatgattaaaattcataaaacgaagaaagaatggactcagaaaatagcaaacatgaaatgttaattattagttcaaaagttagtttaccgtgttttctctgccaactgattgctaatgactaaagtccttatttccagctttcctctctccccgagctccagatctcttgatttattaaactagtagtttccccaaaatatatgagacaacaaaatatactctcagctgaagtaaatagcattcatcttcccagtcagataaggcagaagtacttctagatcagatgttatattcgggataggttaaaaacagaccctgctcccagtgtcccaggaatgaacagtggatgtgcttatttctcattgcatgcgtgtatcaaaatatctcacgtaccctacaagtacatacacttactatgtccctacaaaaattaaaaacaataaatcataaacatttgtaaaaataagcgaataaatgtataaatgaatttaaaagagaatagacagaggggagaatgtaactttacgtgtcccagaacagactttgaacaggctcttatcatataggaaaactgaatgaatatatgcaagcataagtccaataaccagattctgatttacagaatgatcgcaactgtagttctctcaaggccctgtctttgaacaggctgtgtcttattcctgcaacatgctgatctatcttcatgcttcaagactcagatcattatcttctctgggatgtctcccaagcactgccccagaaataacttctcctcctataatacttaatcataatccttggcttacatgcttgtttcttctcattgactatgaaatcctcaagacaaggtatataacgtatatatctttaatcctaatgcccaattgagctcttagaaggtagtaagctcccaatacacatttgttaatttgaagcaaaaaaaaaaaaatagctaatcattcaaaaaactgaattatcacaaatgtccatctaaagtactatatttacacaattaaatgctatacagccaggttaatgaacagactaaaattatatgcaacatggattatcgtaaacataattttgaatgaaaaaggcgagacacaaaggagtataaagccatacaattccattttcataatattcagtaccggcaaaataatcaaagttgacagggtactggttatacttggaggcagtgactgcaaagggataagaggagatttctgagattctgataatattctatttccttctctggttgtacagtgtgttcaatttttaaaacactattgggctatacagttaaattgtgcagtgtcctgtacgtatattacacttcagttaaaagcttccatggaagctacacatagttcccaaaagacaacaaaacaaaaaattttcaattattttaagcacaaacaattttgttcagctgtcttacaatcgaatatgtaagaataaatttatggctaattagcatagagttatatgcattttcataattaaaacttccacgagtacaacatatgttaagtattttaaatcagtttttctctttcctcaaataaggttgtgagtcataattcggaaaacagtttagcatgtaataatttagtgttttattttaaaccaagctgaagccacataaagcagaactgctcaactgagccctatccaaatccttgacccacagaataagaagcagataaaatggctgctacttaaacaaaacaaaaaccttgtttatatttttgtcctctcattttccataagtatactttaattaaacattttaaaacttgtaactttaggttatatacttactttagttggttctcaaccagggacaattttgtccccacccccaaccccccagcatatttggcagtgccttgaaacatatttggttgtcacagctcaggggcgaggtgttactactggtatccagtgtgttcaacaggccagggatactgctaaataccctacaatgcagaggatagctgctcacagcaaagaattttccaaacctaaatgttagtaatgctaaagttgagaaaccttgctcagatataatgacataatgttgttagaatttttattttattcattttaatgtatgtatgtatgtatgtatgtacgtacgtatgtatgtatgtatttgagatggagtctttctctgttgcccggggtggagtgcagtggcacgatctcggcttactgcagcctctgccttccacgttcaagtgattctcctgcctcagcctccctagtagctgggattacaggcgcctgccaccaaacctggcaaatttttgtatttttagtgtagacggggtttcaccatatttgccaggctggtcgcaaactcctgacctcaagtgatccgcccacatcggcctccctaagcgctagggttacaggcatgagccactgcgcctggccaggaatttttgaatcagaatttttcttgttcgattttaatctcttatcatttagagattcttgaaatattgaaattactttgttcaaagtgaatgaattttcttaaattatgtatggttaacatcttttaaattgcttatttttaaattgccatgtttgtgtcccagtttgcattaacaaatagtttgagaactatgttggaaaaaaaaataacaattttattcttctttctccaggctagaagaacaaaagaatatcttgtcagaatttcaaagagatttaaatgaatttgttttatggttggaggaagcagataacattgctagtatcccacttgaacctggaaaagagcagcaactaaaagaaaagcttgagcaagtcaaggtaattttattttctcaaatcccccagggcctgcttgcataaagaagtatatgaatctattttttaattcaatcattggttttctgcccattaggttattcatagttccttgctaaagtgtttttctcacaactttatttcttcttaaccctgcagttctgaaccagtgcacataagaacatatgtatatatgtgtgtgtgtgtatttatatatacacacacacatattgcatctatacatctacacatatagatgtatagattcaatatgtctaaatgtatataattcacagtttttatctttgatttgaaattaattttagattttacttgagaacttcacaacttcatataattttaaaaactgaagaccagattgtggaatcataaaatctaaatctaaatgggaatcacttttttaatctgtcctggttacctacctggagatttgagaagagtctttaaaaagaagaatccattttcttagggaagatctggattgccagatcagtctcaccacttcagcctctacttaaaggcattatattcccccgaagcaatgttttgttttagctgatttgtctgggggtgtgggacgtggtgttggttcacattccatttggttgaatagacatccagcttattccagtggcttttcataccgtcctactgtgatgtctgcttattactgattacttcccttggctgactgacatgctctgattgtgcaattggattaactttcatggttttagttttaggaaagcagctcttttggatctatttcattttagttgtcaagcagaaggtgaaaggggaagagaaattaatatttaatcattccctgttatgtgccaagtattagatacatttacagccactattttatttaatcttcatatcagattttgacaatggttgctattatcctcattttacacggtcacataatcaaagggaaatgaaattggtcctttatcaatgattcaggtgctttacacatgtaaattagagtccaatgtcaaacgtttatttctgtgaaacaagaggtttacacctgaacaagaaataaagtataaaaataaaatatggcgtaattcaataaacaaatatggagcactgactatacatccgatgttttactaggtatttgggattcaaaaatagaaaagagtgggaatcatttgaagatggttataccctagaacaatgaactcagtcttttcttggaaatttatctttcccaaatgtattgagtgtcatatatagtaatataattgataattcattcgaaacatatttagtggcattttcttattaattaatatgcatgagtctattttctcctgaaagaatctagatcagtgctttcaaatagaactcccgtgatgatgaaaatattctgcatcatccatttttgtaacgactagctatttgtgccttttgaatacctggagagttggtcgtgtgactgaggaacttgagattttattttagtgaattttgattaacttgaatgttaatagcgttgtatggctaatgggtactgtagcagacacagtaactttagttgacaaaaatgaagtgttaacaccatggtgattttggaggtcttgggaaagggcatacactatgtggtggtgaatgagttcgagaaatttagggatatgaagtaaaaaatgaggactccagaatgaaactacccaaatttgaaccacacctttgttgcttgctagatttgtgtcctgggagctggtatttaacccctttgtctcagtttccttccatataaaatgaagataattggatctacctgatataattattataatatgaagataaactaagataataaatgtgaaaaggttagcacagtgcctggcactgtgtatattgagagtcaatactctcaatgtcagttacctcttaagatgataatgcaatttctcagcagcaagctacggtatgctatggcatgctatgatacccaagaggctgatgaatttgttcacattgttctatttctgatagagagataggttttcagacactaactttatttggagtgttgctttaccatctcacatttttctcttaaaaaatttatgagggataatataatcgtttattttctacagagatttatctactgagggggtgagtgtttcagtcaatcagctctgtgctcagatagaaaactgttggtatttgaggtaccactgggccctcggtcaagtcgcttcattttgatagactaatcaatagaagcaaagacaaggtagttggaattgtgctgtaattcattttaaacgttgttgcatttgtctgtttcagttactggtggaagagttgcccctgcgccagggaattctcaaacaattaaatgaaactggaggacccgtgcttgtaagtgctcccataagcccagaagagcaagataaacttgaaaataagctcaagcagacaaatctccagtggataaaggttagacattaaccatctcttccgtcacatgtgttaaatgttgcaagtatttgtatgtattttgtttcctgggtgcttcattggtcggggaggaggctggtatgtggattgttgttttgttttgtttttttaacctgaccgtttgctttggctatatgttttgttgtggctagaaaaaatgatgatggtgaatggctttacattaatgaccaaatgccaaaatttataccacaattttttgcataaattattctgaagaatcagactgaagaaatggcgaagtatttaattcagtggccaggcatgtactgacagtatttaagctgaaaggacgtggtctggttctagttaaacaagtgtcataaatcaaaattaattattcacacctgtggtatggacttaataattaatgtacactaacgttcgccacaagtttatttatttacttacctactgatttattaacttgtgagttttcatctttccaccttgcatactatataaatctaacagtaatactatttattaaattaatacatatttattttatataaagcaagtggtacatatgaatttatagtaaaaagcaacatcaattgatccagcactattcattcaaagacaatcatttccccactgtattttcatggcatctttgtcataaatcaagagaacttgtatgtatgaatctgcttctggattctgtatcctcttccatttgattaaatctgtactttaacaacagtacttcactggcttaattacaatcttttttttaaaacaatcctaccgagctataattcacataccattaaactcatttaaagtgaacaattcaatcgtatttcggtgttacttttttaaggtgtgataaaatatataacataaaaaattgtcattttagtcatttcgtgtgtccagctcagtggcatttattacaaccatcaccacagtttatgccccacccccaatttttttttttcttttttggagacagagtctcgctgtgtcgctcaggctggagtgcagtggcgcgatctcggctcactgcaacttccgcctcccaggttcaagtggttctcctgcctcagcctccctagtagctgggattacaggcacctgccagcatgcccagctaagtttttgtatttttagtagagatggggttttgccatgttggccaggctggtctcaaactcctgacctcaggtgatccgcccaccttggactcccaaagtcctgggattacagcgtgagccaccgcgcccagcctccaaaattttttattactccaaccagacagtctgtaaccattaagcaatagttcccctttctctctcttcccatccgctagtagcctctggactactttctgtttctatgaatttggctattctagatcttttatataattggaattatatatttgccactttgtgtctgccttacttccctcagcataatattttcaaggttcatctatgttgtagcatgtgtcagaacttcattcctttttatgactgaataatattccattgtatgtatatacgcaatcattttatttaaacattttggatctggttgtgtaaaccttccactttgttcttcctattcaagattgccttggctacttttggttctttgaataaattttagaactatattgtctatttttacataaagccttccaggatattgattgaaattttgtgaatctggagctcagtcaacatctttacgatactgagtcatctaatttgtgaacattttgaattgtgtcaggttatttattgtattttttaaattggtgatgctgacattctaataacagatcatttacacgactgataaaatatttaggaactaaaataagtaccaattttatgacattaaaaccataatgtgcgcttaagtgtctctatttcaagcaggtagttatttgaaaaaaaaaaatcccttcttggtttctacctttaatgattgcaaaacatctgtgtaaagatacagacttttatgtatggagggaaggtggtgtcccagcaattaaattttatagctacataacaatacaaatgaaatcatccctcataaaaagagaacaaggaggaaggatacccaaaatgttctacaatatctcagtacatcttatgacaaaaagaagaacaaaaattataattgtaggaaatgtgagagaactatctaaaatatacaatagcagctttgtgggttgtgaaagagtcaaggttttatgtgtcctgcaacagaataaaaagtcaaatttttatgatagaaaattaaaactgaggttacgaacaccatcatgtatagacttatattactacagcatccataatatctgtttcctatgccaaaattataattttaatgcaatgtctttgccattaaatgccacaggatttggaattttattcattagtcatattaaaattatttaatcatcttttctccatccatatgcctctgtatccctgttagtttagatttagggatagaaagcaaatgatcagtaccagatttaggtaaataacacaagtttttttaaaagtaaaagaaaatggcttataacactggcagacagtcttgatcttcattaaatctcaagctcttacttattacaggagggtagaaataaagcggaccccctccctgtgtcctccagccctacccttcatccaaaggttagagtgggtgatataattggaactagtgggtcatagttactgtgacatgaatatgtcaattccttagtacatagtatctccaaacatatcctaatatcataatcagttggcaggtgactttctccacagctaactctaatatgctgcattctgcgtattgagccaactgaccccttactcttgtacctttattttatttttttttttatttattttttgagacagagtctcgctttgtcatccaggctgcagtgcagtggcacgatctcagctcactgcaacctccacctcccgggttcaagtgattcttctgcctcagcctctcgagtagctgggactacaggcgcgcaccaccacacccaactaatttttgtatttttagtagagatggagggttcgccatgtcggccaggctggtctcgaactcctgacctcatgatctgctcacctcagcctccgaaagtgcggggattacaggtgtgagccaccgcgcccggcctgtacatttatatttcattactgaagagagaaaacagcaggtgaagataatatagctatttctttaagggagtggtggacagggttgctttaaactgaatatagccattagcgtaaatttatgggtagcttcatgcaatgaaggctcatgaaatgatatcctcattcttgtctaatacataacttgaccttttacagcctttaacaatgatacccgtaagagccacaaagtggggatgttattaaagctagcctctgtgttcctctctctgatcatctcattctatgatcttcacccacacttctgactcaggtgtttttaatatttatccctcttcatatttctttgtattttctctgaacatgcatgtgggtgtaggaggctctctcgccatcatcatcactctcttcctctgtgtttctcacttttaggctaattttcatctatgaattgacacgtatattataggaatttatttttatatatttattaggaatcttctttttgttttttttttttttttgagacagagttttgctctgtcgcccaggctggagtgcaatggcacgatctccactcactgcaacctctgtctcctgggttcaagcgattctcctgcctcagcttcccgagtagctgggattacaggcatgcaccaccacgcctggctaatttttgtattttaagtagagacggggtttcaccacgttgatcaggctggtcttaaactcccgacctcaggtgatctgcccacctcggcctcccaaattgctgatattacaggcgtgagccaccgcacctggccatgaatctacttttctatttgcatatttgccactctttttctgccccagttgtttatgtaacacattctcttctgctctccttccctgaccccgttaatcccagtttcatctctttcatgtctttttattttgtgtcccctttcctcattcttcattgctctttgtatatgttatatgtgggtatttttttaactacccatttatttaaaaccaaaatatgctttatcattctttatttttgaacaccgagtcctagaaaggttatgtgacttatttgagaccatgtagctttctatttaaatataaaagtgattccaaaataaacagtaggggttttaaccttttggtgaagctcaagtgatttttatgtggataatatcctaatattaaaatggggatttattttcttttaaaaaaactatatgagtttttgctttggtttttgccctttttgagaactagatgctgtgttttaaaattactttctagaaccttctctgctgtggaacatttacagttgtgtaatatagcaaaacatgtttatgttgtttcagaattagttaaaatcctactatttttaatgtcaagtaattttacaggtggtgtacgttatgcattcctattagttttaataaatatgttgtcattttgttaaataagtttaaatttttcatcgcattttacatgtaaacagtaatttactatctacacataaaataccatttacaaataagatatactgtttatatgtaaatggtaaattactatttgaatttgttactgcccagacagtataaaatggtgcacataaagaaaaaagcattttggaaaacaattaagaaatttggctggaaagtgaattttagttaagtgcatcttattcactttaccgaggaaaaaggtaggtttacaaatacaacatatataacaaacctttaatatgggaataatttttgtaatattgataataatacaggtattattttcaaaaaatcaccaaataaaaattatgaaagtaaaaatacagtgcaactcctagcacaaactatcttccacaatatacagttggctgtatctaaatttccagaaatctggttcattttgtattaatctctaatcatgttgcttctaaatatgtatctgaggagtaaacatttcagatttattttcatttgtataaggtaaatgaatgtttagtctttttccagacgtatttgctatgtaatgacagtcattattagtcgtcagtataaatgtgaatagcaaaaaggagaaaattaaataaagctagagcttggctttccgactccttgctcaaaaatggacactttgtccaatcaatttcctatcacaagatgacgattaatagattgttctaatagttaccattcagtcctgcccttaacgtgatgttttttcaaccaaataatagaatcttcactggcattgttaccatattgactggtatttatggaaccccggaaaaaaaaatgctgtaaaatatatagtaggaagtataataatcattataggaaatcatttctctagctggaagtcttagcagggaccagatagttccactggagcttttatgtgctcatgattttctcccttgaagtgtatttgtaacacagttcacacagtttttaattttataaatctgtgtgctaaaacgctattatataagaaaacgggccgggtgtggtggctcacgcctgtaatcccagcactttgggaggcccaggcgggcagatcacaaggtcaggagatcgagaccatcccagccaacatggcaaaactccgtctctattaaaaatacaaaaattagctgagcgtggtggcatgtgtctgtaatcccagctatttgggaggctgaggcaggagaatcacttgaaccagggagtaggaggttgcagtgagccaagatcatgccgctatactccagcctggcgacagagcaagactctatctcaaaaaaaaaaaaaaaaaaaaaagggtgttcacctatttattgggcatatagtctgatagttcccagaaacccattatcttgaatgttttctttatgtaagttcctggaaatccattatttggatgttttctttatgtagttaataattacagcaaagctgtaattaaattatttattcaagagctatctattaaaggactactatgtgccacattctgttctaagcatatcataatcacttcccacccttcccttatttaaaggacatgcataattttatagggcttggcattataaatattcatatctctaatttatagttgctaaacagtttgaagctgagggttgggggaagggagtagtaatttaaagtttataacataagcatccttgactttgcctcctataatttcacactgacatgaggtttattactaggttgtgtgtcatgagtacatctcaatttgctctgactgttctggtttttgcctgttatcctatcataatttttaatagctccctctttcattgtcataagtattccactttagaagataaaatatatagagagggtcactctagttatgagaacaaacatcaggcttttagagctaggcttggtccagtgctcaataactattattatcatgattgcttttgttcttagtagcatcatcgtccttgtcatcatcatctaccttcctaatactttagttcagctgagaatttcggcctatccaagaaatctgattgccattattaccgaattaatcactctttaatgacaatagtatataagaatacgtgacatttaactttccaaattattgaaatgttacgctgtgtatggaaaattctttctaaccgtgttttttctctactctcaaatcgtaacaatcgtcaacacagaagaagacttttatgaccaaatttgtggaatttttttccccatacaccaaacagcaggcaccagctgggtgtctctaattcagtcctgacactatccacccagagatagtgtcagatcccatagattgagggctcagtaccgaggtctgcctcctctgcacccccctagcgcacgcgcgcgcacacacacacacacacacacacacacacaccagtctcaagtccaggcctctggaacttctgacccatgggcttcaagttggggttcccatgaccctctctttgggttcaactaacttgctggagcagctcacagaactcaggaaaacactcgctttcacctgtttatgataaaggatattgcaaaggacacagatgaagagatgcatagggtgaggtatggttggggtggagggacggaaaggggcatggagcttccatgccctccctgagtgcaccaccctctaggaatccccacctgttcagctacccggaagctcactggactctgtcctctttgttttttatggaagcttcatgacatcagcattccttccccaagggtatatggtgggaccctctaacaggaggtttttaagacctataatctgaaaggcgagggaacattaaagtgaaaggagagcaggagaaggtcagaggcctgcccctgagacccaacgcaaccaacattataacaaaaaactgtaacaagggctatgggtgttatgagccaggaacctggatagaaaccagtatgtactataataccatataggcaatgccaagaatatggatcagacactttacaaacaaggaaaaagtaaacaggagtgatgaggaggtaatttactgcaggcattaatgatgagattatgaattatggattccacttgctaccagctatgtgatcttatacctactctgtccatacctaagttataacatccataaaattcaaatactaaaagaagacacttccccaggttgtggtgaaaattcaatgaggtagtaaatgggaaatgtgtaacacagtatctggcatattgtaattgctcaaaaaatgttagattaaaaacagtaggagtaatactaaaatagaaaaatgcaaagagcaagcacaaaatcatctctgattctcacctccaaattctccaaaagtctcaccttcttaatcaaagttgtaaatatggctcttggggagaaagctgaactatgtgctactattatgaatgcaacaggtgaaggagaggagagttagaggcagcaagacaaccaaatggctctcgtggaaggcacagaggattttcagccactgctctcctattccgctgatattactttcattttctatgaccaactagcatttcagctaaaatgtgttggaaaatgatagatttttctcctcctattgcctaagaagcccaacaaagccagcattgttttcaaacaccagcattctcacttttaaagtatgaacataattcagaggacttttaattctgaacatcgtttttatcaatctattggcctgattgtaacccagaaatccaagcagaaagcaagtaaactttcacactgcttccccatcccttccccctacctttatttttgacatcagtttccctcattttggcaaagtaaaggaaaagcatttgtagaaggttacactgaagctagataattttctattaggaaacctcaccaaatacaagataatttgttcattccaatataataatgttttaaaaaatataacaaaaatccagcataaattgtgaagcactgatacttgtgtaacaactaatttccatagtgaaacttcattgttgccactatctacatactgaaaatgtatatcaagcatgtaaatgtgtcacttaagtatgctgtgccctagattttatttaaaagttaagctaattttcaactaaaaacaaattcgactattcttagcaatctctcctccccgttcatgatggatttaaaatgatgaagagtataaatgatgatgaaaagagaaaggaggagaaaaatttcataactctgcatcttcagtgtagcatttttaagtaactcctttattagcacaaaggtgtttgcctgaagcaatgacttctagaaaggagaagaaatgacataataaaaggggattttgctaatataaaatgttttttctttccttttgtttctgcaatgcttttacttacatagcaccaaccctgagactagagggagtttccttcctttctaataatttaataatcgtgaaatgatattaaatggaagttttcatatgccaactccttaaactgaggttaaataaggaacaaagattaaaggccatatttaagaccacatattgtaaattctaacccagtttcatttattatatcacctgcaaagccaatatgccatacaaaagtaaaataacagggtgatttttattaaagatcagaatcataccaaaaatgaacttttctgtcaaatctttatactcatacatcaagatgtgagtttatttatgtagctaaaataacttaatactaaatgctgactactatattcatgtcagctgacccctagtgcttcaaaccatagaaaagggataccaaatgctgggttggttgtgtattccatttttgccgtataccacctgccaaggcttataacagatctgtaatgggtttcttaccttttattgtgtagaaaatggattgttggattaggcctggggccagtgaaccatggaaccccaggtttgcaagaaagagtttatcaccctttgatgttatttctgtctcgtgtcagctgagaaggatgagctagattatctgaaagtaagctggatgccaaaatcagcattcccctcatttatccaccttatggttcggggcaagaccactgtatgggtaacaaaagggctgataagggcctgatggagaaatttggtttttctcccttttgattggcttgctgatattagaaccaattacaagacattgacgagagcatttcattgtttgttgctagagaaaatccatcaattttgttgtggaaatgaaagcatttgagctgaatgttgcacttataatttgtgaacattttcagttatcaccgggacaagtatagtccatctttggcatggttggccaagtgtggtgggaaaagagatggaccagcaaatgggccggaaaccaaagtcatcaaaagggtatttcaagaaaactctatttgttctgatggttacattctgcaggcaacctgtgactgatgactgatgcttatacctcaaatgcagtctaaaaatatttttttgtgaaagtgacacattctgactgtgatgtgggtgacatcaacagttttgaataggacagtacttcttggacttattgaaacttttataaaagaatgaacattctgaactcaattgcaatgtaaatgactatcatgaagattgcttctgttggtgctatgacttttgtgacaaattttagaccattgcagttatctcctagaggttgctttattgttttattttcatcagtgatgtgtattttatcagtgatgttagaatcactgagctgctggttaaggaagagaaaaaaattaatattcaggtgctatataggcccttattcattgagaacaaataaaggccaacacacaaaacaggaaaattaatagaaaagacactctatgggtaagatttcatatagtttgggagcagacaaaaactattttaattactaaaataattaagaaagatgttgaggctgggcacggtggctcacgcctgtaatcccagcactttgggaggccaaggagggcaggccacttgaggtcagagttcaagaccagcctggccaacattgtcaaaccctgtctctactaaaaatacaaaaattagctgggcgtggtggcacatgacttgaatcacagctacttgggaggctgaggcaggagaatcatttgaacccaggaggcggaggttgcagtgaaaggagatcacgccactgcattccagcctgggcaaccgagtgagactctgtctcaaacaaacaaaaaaaaaaagattaaaaaaaaagatgttgacattaacatgttcaagtctttatgctgaaactagaatgcagtatgattaaataatcatttctacttcgggtgaaggattagttttcttaaagatacccctttccagcttctcagttcgcgtgtggttaattcccaacgtggcctcaaatattctaatggtttgtgtaatgagtgccaccgttccaccttcttattctccatgcctcatctcagtcctggaaagatcactaaacttgcagttcataactcagtctagacccaggttcaacactcactaactcataactgtgggccacttatttaaatctcttagtgcctctagttcctcatttgtccaacagtgatgcattatgaagcatgtttgcccatctcccagcgtctagtgaggaactaaaaacacaatatatactatcatactttattacgaggagttaaattgtggttactattacaaagtaggttaccataaaattctaatagcagtggtaaggggtaaagatccacgtgccatcacgtagagcagaacttctcaaactttaatgtacggcaggtccttgaataatgttgtttcattgagcatcactgtgttataatattggcaagggaaaaaactgtatctcagctaggggggcactgtctatgtggggttttcttttgtctctgtgggttttcttctagtactctggtttcctcacatgtcccaaactgtgcacgttaggggaattggtgtgtctacattgtccccatgtgagtgtttatgtgtctacgactgtgccctgcgatagaatggcatccctgccagtgttggctcctgtctggtgctctgagttgccaggatgggctctggcctcccaagtccctgaactggaatacgtggcttggaaaatgaatgactgaattaatataaattactgtgaaataaaaattcatatagtattcaataatcataaagatgcgtgacaataattgatgctctacagaagtgctcagtgagctgccatattgattattgtttgtttttgaactttgtggtgagagaaggcaatcctggcagtttatgctttgcaaacatttattccttgaatgaaccaccgccactgcaaacactgtcactcactgattcaccaaaaactgggtaaataattttcctcctggtttttattaatctttctaaagtggatgtatatctcacatttatttctgagtttaatattagaagtgcttggggtctttatttagatgttggatcatgttttgtgaacacaggtatgcagtaggaacttaattcttgtttatcaattagcctatggtaagattggtttcattatatgtcattttgcctaagtcacagtttcccagaatctatcaacaacattaattgatgacttactgaaacaggaatcaccttgagatcttgttaaaatcaggttactgattcaatggctcttgcataggacctgaggttctgcatttccccccctaatttcaagatgctggttccctggtccccttgctctacttcttaaatggtagggaggtagagagtggctatcaagagtctgtgtaggagttgaccaccaatcccattcaatggaatgcatacagtgtgttctgagatactggaaaggcctttgcaaaaagattttgtctcttgatatttatgaagcacattcatccgaccacagaagatacatatcaactttgacagaaaatatgaacacattcaaatgatttatacctttgaaacatagatcgttgtggggttcataacccaagtataactttcccacagattcactcaatttccttcctctttctgtgcaatatattgtatattgcaagaagctcacctccactcaccttattcctcaggctttcttctcaactatcttctgtatagatttaaccagtgggaggcgttggcaggagattggagagcaggagaaggggagatttcagggtatttctttccctctttcactgctttgggcaacagctgatacagagtaagtggccaaaaaatactagctattattaggtcttctaataatgatcttctaaaatcactttttcagtggttacccccattgatttgccatgaatgtctcttcagacatctttgcaaagaattgagcctgactttagatactcattcaaaatcaaaatcagtaattttaggattgaggactctggtattatttaagaactcttaactgtaccaagcctcactcccatttctggctttcccctatatatcagttaagtaataactccaatagtgtaaaatttgcaatagtgttatgtaacaaatcaccctaaaacttattgacttaaaattatcaccatttataattgcacacagtctgtggggtcccgtgagctgttgtgttgttctggctcactcatacattttcagtcagctaatgggtgggctaggggctggcttatctagcataagcgcagctaggatgattcacctctgctccatatggtctctcatccttcggcaagcgctcctgggcttattctcatgcaagaaacaggattctaatagagaaggaaacaagacttcttgaagcttaagcttggagctggctcactcatttctaacacatttttttaaccaaagcaaatcacaaggcaggcccatattcagggattagggaaataggttacaactcctgatggtagcaactttaaaagtcacattgcaaaaagatgtgcatacagagaggtcaccagtgcaatctaccacaccttgcaatctattaagtttctcaccccctcacaagtaaggtattcagttaagatgcattcctatgtattcagatttctaatcaactaatcctgattctcacgtaatattgacacagtatcaatattctcaaaagccaatagtctagagggtcacaaagatcctcaaagatactttatgcaaaatcctaggagtatagaaacagtaccttggtttatgtatacattcagtatttattaagtgtttccaatatggtataatgttaaggaatgaggatagagttatgaacagacagacacttgtctttatggatcttacatttggagggggacaaacattaaaatggattatataattacaaatgcagccgttctcattgtcttttcagatttctcagggtgtagactgagctactataataaaaataccccaagtttccatgtttcaaacaatatagatatgtgtatctttcccacataaagtccagcctaggtacgtagtctctgctctaaaaaggaacacaggctagcaaggcagctatactattctcaatataatactgcatttcaaaatctccatgctggtcccacaaatatccatgcactctctttcttatcatcaagagaacacacagtgccttcccaagagagaccagtcaaagtctcattcacttactgcatccagctaaaagtccattgtctgtggatgatgcactgtcttctccatcagatcaagatatggttcctcatggtccagtgacctataaagtgaaagttatgctatctgctcctaccacaaccaattctctctttttaaaatttttttaaatttttgtgggtacatagtaggtgtatgtatttatggggtacttgagatgttttgacacaagcatgcaatgcataataatcacatcatggagaacgggggatccaccccctccagcattaatcttttgtgttacaaacaatccaattatactcttatttatttttaaatgtgcagttacattattttgacgatagtcaccctgttgtgctatcgaatactgggtattattcatttttcctaagtattttttgtacccattaaccatcccgctgccccctccccgactcctccactatccttcccagcctctggcaactacctttctactctctatgtccatgagttccattgttttgatttttagattctgcaaataagtgagaacatgagatgtttttctgtgcttggcttattttgcttaagataatgacctccatttccatccatgttgttgcaaatgacaggatctcaatcttttctatggcagaatagtactccatttgtgtatatgtaccacgttttctttatccattcatttgttgatggacacttaaattttttccaaaccttggctattgtgaatagagctgcaataaacatgggaatgcagatatttcgtcaatatactgatttcctttctttgggtatatacccagcagtgggattgctggatcatagggaagctctatttttacttttttgaggaacctccaaactgttctctatagtggttgtactaatttatattcctaccaacagtgtgcaaggttttccttttctccacattctctccagcccaggcacaaagacagcagtaagtgctggacgaccacctatgcaagacctagactataaatccagtacttctctccctctccacacccccatacccaccactccattctgagttttcaaatgtaagctaagctaaatgattcaataaagctttttgaagtcaaggatgagaaaaatcgttgctttttatgtaatcccaccatcaaagtaataattgcttagttcaaattgtggtgatgcaaacaaggaaagcaagagagcataaaacgggtggatctgacgcagtccagaagtggaggcaatggttgtttttagataattattagagaagatactgtgatttggtttgaaggcaaagctcactgaagttctctagttctagatacacctatcgaaaaattcttacccaaataaatgtctcagtgataagagcagcctttccccaaatgcctaagtgtttttgttttgtttttgttttgttttgttttgttttgttttgtttttgtttttgttttttttcaaaatcttcctctggaatggatgctgaccttgtcattgacttattcttcaccacaactcagtcatattaatcttgaaagagacagagaggccactatctctgctaataatttacataattgtttttctacaatttggtgctaattaaaatgtgaaaggggtagtgatgatataggtaaatgtaataaggtcattctttgttcctgagagcaaagataatgtcaccagaaaggattgtctgtatattcacataagagcaggaaacaggaagagagacacagtaaggtaaaatagcatactagtatatcacgtagtctggtatagccaatgtagaatatttatttcaaaaaacaaataaagataaagttctgcttcactttgagaagctgttttttttaatcctgtatagttagttcgacatgttactactctgcctggttcaaattttgatttcactctgttccagttatatatgctatgcaacaaaccactctaaaagttactggcttaaaataagatagttttacgatttctcataattctgagagttgactatgatattcatctgcttcacctgatatcaaccaagacactgggaaagctggaaagtccaaaatggcctcactcacatgactggcagttggtgctgcctaccagctgagaactcagctaaagctattggccatgagcctcagtttgtttccattgtcttctccatgtgtctcctttggcttccccacagcttggtggttgagttctgtgaagaagccttccaaaagaacaagcaccaatcttcaaagacttatcaagcttctgtttgtatcacacttgctactatcccattggccaaagccaggcatatggccaagttcagaatcaaaatgagaagggactacacaaaggcatgaatccaagaggcgtgattaattgtggggctgccaaataatcgccttccacaaattccttactagctgtgtcatctctctgtggtctcagttttctcacctggaaacaggaacaaaaatggccctacaaaaatggactgagatatattaggttggtgcaaaagaaattgcagtttgggaccgtgaattttaaatcattataactaggctcaagcacatctttattaatcaaagtaggaaccgttacagtcaacacatttttgccaagaagaaataagtgtgtttattcctgtagcataaaaattcatgctttgggattcaatgaactcttggaaagcattttcttcatcctgctagttgtggaagcattttccctgtaaaaagttgtcgagatgcttgaagaagtggtagtcagttggttgagaggtcaggtaaatatggcagatgaggcaaaacttcctagcccgattcattcaacttgtgaagcgttggttgtgcgacgtgcggtcgggcgttgtcacagagaagaattgggccctttctgttgaccactgctggctgcaggcatggcagtttttgatgtatctcatcaatttactgagcatacttctcaaatgtagtggtttcgccgggattcagaaagcggtagtgggtcaggccagcaggagaccagtgaacagtgaccatgacttttggtacaagtttggctttggaaagtgctttggagcttcttctcagtccagccactgaactgggcatcgccagttgtcgtttaaaatccactttttgttgcacgttacaatccgatcaagaaatggtttgttgttgttggcgtagaataagagaagatggcacttcaaaatgacgatacttttattttcgctctgcttatgaggcacccacttatcgagttttttcgcctttccaatttgcttcaaatgctgaacaactgtgaaatggttgacattgagttcctcggcaacttctcgtgtagttgtaagaggatcagcttcgatgattggtctcaatcggtcattgtcaacttctgatggccagccactacgcccctcatcttcaagactcttatctcctttgaaaaacttcttgaaccaccactgcactgtgcgtttgttagcagtaacttggccaaatgtgtttttgacattgcgagttgcctctgcttctttacaatccattttgaactcgaataagaaaaacgctcgaatttgctttttgtctaacatcatttccatagtctaaaataaacataaaataaacagcaagtaataagtcattagcaaaaaaaaaaaaagtgagaaatgctcattaaaatgatgtataacataatcacatttatttaagaatgtatttcaatatcaaatggcaagttccatgaatgtgaaaacaacacttacttttgtagtcacctaatgacacatttaagaagctgaaacctgagctcagcacatggtaagacatcagtaagtattagttatcataatttttttagtaattttcctacagagctataaataaaatgaaatactttccaaacagtgataaaactataaagcagcaatacattataagcttctatcctaatctgccttcccctcagggccttaaaatgtgtcatttctgtaaatgttacctctgacatgaaagcaccaacacactgttcagcaattacaagttgattgtgacaagagcctcactctccctatttctttttctcttcctgtcttgctttcccttttccccatcctttcactcactttgataaggcaaactgccatgtagtcacaaaatcctagacaaacaagtctgtacctatgtgggcgatgctgtggatttagtaagggaaacagttccttgataaatttctcctttagccctgggtttccaacccctgtgtcattcagctatagaaatcttctgatattttctcccactggtcattttcactcaggctgccatcaaaatgagactacccaatgttctttccatttgttctgttttcttcctcgcctctgattccctgcctggtccacttagaaagtctaccttttttccttctctcttaataccaccaatctctaaatctgacttctcctttctaatcccatagagcctgccttgtcatctccaaacaagatccatcttggcctcctgttatcctcagcccacagcagtatttcacttacaacgttcgttagtttctacctcagatgtgtcaggcatttagtttgtaccaatattttatttctttttatatctacaccaagcctgcactagacggtccaaggagaaatttaactgattcctgttttgaagtcctccccactccttgggagagttaaagattcctcagtgtgttaggtaatgatagttaatatttattaataacttactgtgtatcgactgtattctaagtgctttgcactgttagaaggagaataacctaagactgtgccaaacagcagtctagaacaaagctgaattccttgcttgcctggcaagggagaatgtggtacatactaaaggattaatacatgttcactattaaattgattgattgtggtggtggtgacagtggtgatgacttttcaagtgtgggtaaagtaattttttccaacaaatccacatccacatatttaagaaaagagagacatttcattctatctttttgtgtgcctttgagaggacacccctggcacccaactcccaggcaaatgccaccatctgtgtgattttccttcatttgccaacgaaggcacagcaggtactactaggttaacctttgctttcgcaagtcttctctcaaaatagtaaacacttcagctgttggaaagctctaatctcaaactgcaaatttaaaaatctctctctggagttcaaaaaatagaaagaaaaaataaaaatctctctcttctggaacataatgtttgaactgttacatattattcacactatttcacattatgggattatgaaatatggttttaggtgttagaaaaacgaaagaaaactattatttgttaacactaaccgagagatttttatgatattcaagtaaaatgatagaatgaattattttaaaaatgcatgaatcttcaccttctgtgaagtgtcatggaggattagttctaactaatatgcctgtaagtaactgacttaatgcgtctattggttctcttaatgctgtaagtgacagaaaactggtctcaaactgatttaaacaataaatatgatcaaggttccggttttttgtttcttgttttttttttttttttttcacatttctctgggttctatttttctgtgttgacctagcagcttcacctgacttccctcttggtgacaaaaatggcctgaagccgtttcagaacccacatctgcaaacttacttttgatgaaaatcatctctttagggaccttctttcccaaagcatccaggaaagactgctctgaaactgactggcctgaattaggtcacatgctcattcctgtactaaatcacacctcacttctacagctaaaagtcattaaatctcaaccaaactctacagctgcaccacaacaaaggtagagaagtaggtgcaaagttcctcaaaggaacgtaagggtgaaagatgattgactgataaacagacaggtagacagaatagatagatgaattaggaaaagataaccaaccaatatctgtcacattgctttgacttgattttttagtcaattaatgaaactgaatggtaattttgacattacaacaatactttccaaatgtaggcaggttgtggagatcatttaaggaaaaaatgtatgaggtgttgtagcagatactgtcggtgccccaccgatatccctttagcacttaccatttttatacgtgcttcttaatttccaacttcctgtacttgcatctctttgcttggggctatctctgctcattcttgggagagagcagaaatgtagcagttatgcccctgtagagcagcagttgatagatcaataccctgtcccccttgcccttcagatctaataactccaagcttaattccctacatctttcatataagtatatatataagtatatatatatacttgaagttctagggtacatgtgcacaacgtgcaggtttgttacataggtatgcgtgggccatgctggtgtgctgcacccattaactcgtcatttacattagctatttctcctaatgctatccctccccagccccccaccccacgacaggccccagtgtgtgatgttgcctgcgctgtgtccaagtgttttcattgttcaattcccacctatgagtgaggacatgcggtgtttggttttctgtccttgtgatagtttgctcagaatgttggtttccagcttcatccatgtcccttcaaaggacataaacaactcatccttttttatggttgcgtagtattccatggtgtgtatgtgccacattttcttaatccagtctatcactgatggacatttgggttggttccaagtctttgctattgtgaatagtgccgcaataaacatacgtgtgcatgtgtctttatagcagcatgatttataatcctttgggtatatacccagtaatgggatggccgggtcaaatggtatttctagttctagatccttgaggaatcgccacactgtcttccacaatggttgaactagtttacagtcccaccaacggtgtgaaagtgttcctgtttctccacatcctctccagcatctgttgtttcctgactttttaatgatcaccattctaactggagtgagatggtatctcattgtggttttgatttgcatttctctgatgaccagtgatgatgagcattttttcatgtgtctgttagctgcataaatgtcttcttttgagaagtgtctgttcctatccttggccgacttttcgatgaggttggtttttttcttgtaaatttgtttaagttctttgtagattctcgatattagccctttgtcagatgggtagattgcaaaaattttctcccattatgtaggttgcttgttcactctgatggtactttcttttgctgtgcagaagctctttcgtttaattagatcccatttgtcaattttggcttctgttgccattgcttttggtgttttcatcatgaagtccttgcccatgcctttgtcctgaatggtattgcctaggttttcttctagggttttatggttttaggtctaacatgtaagtctttaatccatcttgaattaattaatttttgtataaggtgtaaggaagggatccagtttcagctttctacatatggctagccagttttcccagcaccatttattaaatagggaatcctttccccatttcttgttttttgtcaggtttgtcaaagatcagatagttgtagatgtgtggtattatttctgaggcttccgttctgttccattggtctatatctctgttttggtaccagtaccatgctgttttggttacagtagccttagtttcctacatcttcttttagggataacagggagtattaagattcagttgttcacattgatgacttgcatgataatataccctttattggctatcttccctatttcacttcttctcaccctgttgatgtgtcctggaatcacatcccaaaactacttgagctcaaatttttatttctgggtttgctactgggagacccaaatcaagacagttggcttcagtactcaggtacttacaaggagatcatggatatcaattgaatcagaattccatgtcatagcttttcaaatttatatcacaataagttgaaaagatgttgattcttccttccacagtattttctgtttctgtgtgtcttacattctggtgtctcaaaacatggctgcaaccagggaaggaattgaaatttggagtaaatgtcctattttagtaggtctacatttaagacatggacctgaaattgagatcataaacaaaagtagatgtgagcataaagtagaaggtgaggttggagggggaaattgtttggatttactgtaaccaatggagctgcttagtctagtcaaggaatttcaatcatttctgtggagactagatgacttatgttatacaaggatatctctggaaaattcactgtacagttttactaaatctggctgataatatgttcactcaatgttatgatgtcaataatagaatggatattgcctttaaagacaattttaaagtaaatatctcacatattcctactcatttatcaagggctgtgtcattcatggcaatataagataattcttttcactttcaaaatcttccagatgcagaaactttccaatatttgctgtagatgaaagtgtacaatttcacaattcaatgggacaaaaagaattaggaaaaatatgtttcagagagtttatttggtatcatctacaagacctggtatgagacctggttggtgttgtatggaatgaaatatatcagtctgttctcacactgctaataaagacatacctgagactgggtaatttataaaggaaagtgatttaattgactcacagttcagcatggctggggaggcctcaggaaacttacaatcatggcagatggggaagcaaacaccttcttcttcacatggcagcaggaaggaggagaatgagcaaaagagggaaaagccccttataaaaccatcagacctcgtgagaactcactgtcacaagaacagcatgagggtaaccgcccgccgtgattcaattatctccacctgatccctcccaggacgtgtgggggttatgggaacaacagcttaagatgagcttttggtacagacacagccaaaccatatcatagagtttcgaatctgaaaaacaaaagaagctaatttagtttcagaaagctgagatttcatgaaccatttaaaaattcactttataatttttcatgcattttgaagcctttatcctttaaatggaaatggaatagaactattattcgtcatttctaaactgtgcattcatcaacaattttcagaagttaattccaacatgtcttcatcaactctatattacatgttagtacactacatctctattttcatgctataattttttactttttcctcacactttcatctcaccctctcaagatgtgttaatcccctttgctcttttccccatctcgtctctgttgcctttctccccccttcctttttttttaatttctgttctcttttacctgaaatctccctcttcatcttttgctaccaattatgttcttaattggttgaagtgagcaaggtaggaaattctccattttgattccattctctcacatggtttatctttaatatgttttaataaacagtttaacataaatcttacttccaatttaacatgtaaaatttagaaaattggtgaaaaatatgcctgctttttcacccccaaagaaccaagtttaaaaagttttgtgactttgaggcatccttttccctaaaagcaagcttaacagattcttagcattcgtctctgtgtgaaattgtggaaactttaaaaaaactatttgaagtaccaacaactcaaagataaattgtctgttttaaatgcaaggtgctaaaataaaactagaagattgacaatattattcatctttatcactgttctacttaaaatttgaaaattaatgttagaaatgtgagagggtgcatgaaaccttaatggttttatcatttcatctgagtatatatttgatttcttctttctgacattgaaactttaaaattcgccactatttttcagtaactcgttaaaatatggtccgttcttatatttgcaatactcctatactgaaaaccctacaacttcaccattatttaatttttatgttactatatttgtttcttaaaaagattataatattatgtattagttgtctattgctgcataacaattactacaaagataggggcttaaaactgtatctttagagtatcaggatacatatgggtcagaagtctaggcatagattatccatattctttgcttcggggtctctcacaaaggctgcacactaggtgttggccagggctagggtctcatttgaaagcttgccttggaaggacctgcttccaaactcacctgttgttggtaagtttcagttccatgtgggttattggactgtagtcttccttttcttgttggctgatggccacgtttagttccttcggtctctaacatggcaatttgcctcatcaaaatcagtgagagaaagtgggggaggggggaaagagacagagaaagagtgaaattgctagcaagacaaaagtcccaatcttatgtagcctaattggagaagtgatatccttttgtctttgacatattctgcttgtcagaagcaagtcaaaagtcttgaccactctcaaggggaggaaattattaaaggactcaaatactaggagacagagatcactgagtgccattttagagtcttcccaccacggattatttcccttcacctgctggcatttgaaaatgcagctaatactctgggattctccaaacctaatttttttgtataattagagaagtatttgtcataatctgttaagtgtagtaatatattaagaaattgaatttattccttcatatttcaaaaagtacatggggttgggggacagctatgttgtcataaactttaatacatacatgattggaatggattatgaaatatttttctctaagagatagtataaggctgcaaccactgaggctcccaaatacagatgattcatatgtatttagttttaatgcaaagcttctcatgctgatttaaactctcatattttcatatatggtgttttattttttatataatgaatgtctataaaattcctattattttttcaaaagtattgtggcaaatatttcctagtaaaatctaaagatatctttgacgtaatttttatgctctcatttatgttaagaactcaatattgaagtaatgttctttcttatttcctagtaactaaaatccttactatattcatgaagagctgtgcctctattaaaaagcttttattgcaaacagaaatgtcaaaatacagcaaaggtagagctatgtatgattcttcatctgtaatgtaattttaagtatacattttattgcataagcagagatttatacccacatttgctttcagtattcacagaagaattttcatatgtatttcttaaaataacaaaatggctgctttggtgtggggatagtatggtacagcatttattgtgaaaatgattcttatcttccatctttttcaaatggtgagttcagtatgtttaacattgctggttttataatattgcgaatatttttgagaggaagaaacaataagagactgataagaataattcatatttgctcaaagtttaatcagttttttatttgaacaaaaacttggacgaaatgtccaactttcctttgagatcagtgctctccaatgtggtaacaacagcctaccatatgagcatttgaaatatggctagtccccactgaaatgtgctgtaagtataaaacactcaccaaattacaaaacctaagtatgaaaaaaataaaatatctcattggtactttttatattgagtacaggttgaagtgacaacaatttggctatttaagttaaagaaaatataacattaaaattaatttgacctgttttttacttttgtaatgtgtagaaaattttaaattacatgtatcgctctcattataattttattggatgtcattgttctagataaacaatggcaatgttgagaggtgtcataatagggacaattgtctctgtgaagaagaaattatatgaaccctacaacatgtattagccgcagagttgcttagaattgacttactctgtcttgttgaaaataggttttcccttaaaatctctgcctgatgtagccaaccacgattcaatgagcaaacaaaaatcttaaaggggaaaaaatcattttttgagtctattttacacacccagtatcaaaaagaaaaatataaatccacaactaggattatacgggatgtaattcttggatttcttttggtcttataatgctttatacctaggagatgttcaacaaattattattgaatgattgtagtttaaccgtcagttacattttgcagcaatacatttattagtagcaaaatctgagtgtttactaattttcatcacctaatcagcaaattagtactgctcttatatcgctttgcctacgctctactcactggttcaatcagctaattttttcagaattttatggtttataaaccactatatgttgcacagtatttcctatacattagctcatttgagtcacagaagttataggaggtggatcttgtctttctttgttcagaaagagaaatccaggttcagcgaggttaactggccttgtttaagatcagcacgttgctaggtgacagaaggtgttcacttctcactgaactttgcatatcaaaagagatttaaagaattcactttggagagcgggagttatggggtgaatattttatcatgttgtccgtcttaataatcaccaatttgatactaaggctgctagtcatctctaacgaagagaagttactttgaagttggttgattgattgttgttgattgacagaagtattagttttcagaatgaactaattcattaaagaaataaaacattgggtttgttcattccataaataattgaacatttattatgtgtatgataccagcctaagcagatacctaaaaggaatggagattactatagttaataacaatgcattgtattcttgaaaattgccaagagattacattttaaacattctcaccataaaaaaatgataagaatgtggggtaatgcatatgttaattatctcaatttagccattccacagtgtatgcatatttcaaaacatgttgtacacaataaatacatacaatgttatgtgttaatttaaaaataaatacattagaaacggtaaaagtcactaggatcatggaaataaaaatgtttacatttatgtaaatattagtaatataatagagggcatatccaaaatatagtgtcatattaataagatgttgtatgattattatagactacaaaataataaaggaatagacagaatgtttctaaataaagaatagaaattacagtgaagcggaagagagagtaaccctaaacccttcataatcctccctttgcctcgtagtatagcttggaaagtaattatgtggaaagttgagattgcaacaaaggacggtagtacaggagttgcccaaggacagacaattattttctcaaataaactatagcagaagcaaaatggccttggaccacaaaagaaggccctcatgtagacattgttctattctgaagtagaatttgcagtactcaagagaagaggaaagattattataggtggagagactgtaaacaaaatattatggtaggattcctcctgaatagagcaaggtgattgtgtttgacattgaaaaggtatgtttgggcaagagtttgaaaacctttagccaccatgctaagagatcttaaatctttatctctgagtaagggcggtggttgtggttaatgatccttgagcacaactctgtcccattaaagacagtagattcaactgcttctagcattagtccatatcagggagtaaagtgatccgatacattattttcccccagtaaatggttcataaaggaaggccttggctctgccttgtatgtctacatgggagaatataccagaatgtctagaggagcatgggtagcgtaacctttccccatatgcacatacaacaaatactgataatccactcacaggggagggactcatttttaagaattaagttttattttagaagactcagtctgatggcaatgcaggggttgaattacagcaggtagagactggaggtctacaaactggtttgagatatatattttttccggtggcccagataataaggacttgaacagacttcttgctctgggaatgtaaaaggccaggctggatgtaagaggttaggaagttccaaactgtcccacattttcctttcttctgagccctccaaactgtaccagactctgcatgttacgcacttccaaagtcgcttccacattttcgggtgtcttttcagcagtgccccactctactggtaccaaattactgtattagtccattttcacactgcggataaagacatacccgagactgggcaatttacaaaagaaagaggtttaatggacttacggttccacttggctggggagacctcacaactatggcaccaggcaaggaggaacgagtcacatcttacgtggatgggcagcagtcaaagagagagcttttggagggaaactccgcttttcaaaaccatcagatctcatgagacttattcacaatcactagaacagcacaggaaagacctgcccccatgattaaattacctcccactgggtccctcccataacacatgggaattcaacatgagatttgggtggagacacagccaaaccgtatcagtgatgcaaaataaaagaagactgtggagtaaattacacatggagaaaaggaagaggaactaggaagtatagatactgtgagaattaactctctgttctacaaaagaagaaatgggcttaaagtggttccccccaaaactaaaatccaaaggcacataagtcataatgcacactgttacaccgagtccttccagctcttaacttacttgttttactgcactacacttgacttgagttttagacttagtaaatctgaggtaaatgcagattgagaatgagaacaaaatgttaaaaagagaagcagtctcattttcttactactaataggcattgcagtttgtgtgggctctagcagggatgtttgtaccactgggatctaagcatctatttctatattataaatagaaaaattaggttgagctatcgcgactccattacaaacttatggaattagattctctggtatggagcttggatatacatattaaaacaaaataaaacaaaaactcctacccaattgattctgctgtgtgctctagttaagactgttatggttaagaaaataaataatcgctgtatggaatgtatatcgtcctattttaaattaataaaaaaaattttgcaggccttcccaccttccaactcctagagacaacaaatccagatttgaaaatcagtcatattaaatagttgtatcgatatttaccctttgtttctacgttattattttcttcaattttcacacgtatttgttcatcagttggttatgatggacttcactttttttcagtcttacgaatgagatttctccctccaaaaatcaataggcacctgctgattttatttattccaacatgaagttgcagaaaatgaatatggccaaaaatggttaaaaaaaaaaaagcctgttcttcaaaagactagatcgtcagttgaagcagaaaattatattcagtgcactggatttatgcattgttttagccttctccaaccaatttagaaatgcattttcttataaaattgagattattacaaatcctgtgctaagcagctgaaataatgtgcctatgccaaggtcatatcttaaaagtttggaggagcacactgcaattgaatataagtttataaatgtattccacatacttttctgatatattttaataatttaatttttacattttacctatattgtcttcattttcactttacctttggtggtgtttcatacatattcattgtttggaagaaattaagcagacagtattctaaagtcaatactgagtctgctaatgaaaatggttaagttaattaactaaatggcaaccttcactgaacttattcaaagctatttcccctcatgatgtgttttcctgaagaaatgatgcataaaaactaaacccctgttattcgctattcttctgtatcagcctctaaattgtcactttacatgttacaacctgttgcatgatgattaattatgacaatttaatggcatgtaaagggtaaaaccctaaaggattactcaaaccatcattccttaagaaaagaaattgtaatgcctaggttatcttctagggtttttatggttttaggtctaacgtttaagtctttaatccatcttgaattgatttttgtataaggtgtaaggaagggatccagtttcagctttctacgtatggctagccaattttcccagcaccgtttattaaatagggaatcctttccccattgcttgtttttctcaggtttgtcaaagatcagatagttgtagatatgcggcgttacttctgagggctctgttctgttccattgatctatatctctgttttggtaccagtaccatgctgttttggttactgtagccttgtagtatagtttgaagtcaggtagtgtgatgcctccagctttgttcttttggctcaggattgacttggcgatgcgggctcttttttggttccatatgaactttaaagtagttttttccaattctgtgaagaaaggcattggtagcttgatggggatggcattgaatctgtaaattaccttgggcagtatgaccattttcacgatattgattcttcctacccatgagcatggaatgttcttccatttgtttgtatcctcttttatttccttgagcagtggtttgtagttctccttgaagaggtccttcacatcccttgtaagttggattcctaggcattttattctcttgaggcattaccattcaggacataggcatgggcaaggacttcatgtctaaaacaccaaaaccaatggcaacaaaagccaaaattgacaaatgggatctaattaaactaaggagcttctgcacagcaaaagaaactaccatcagagtgaacaggcaacctacaaaatgggagaaaattttcgcaacctactcatctgataaagggctaatatccagaatctacaatgaactccaacaaatttacaagaaaaaaacaaacaaccccatcaaaaagtgggcgaaggacatgaacagacacttctcaaaagaagacatttatgcagccaaaaaacacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcggtgtggcgattcctcagggatctagaactagaaataccatttgacccagccatcccattactgggtatatacccaaaggactataaatcatgctgctataaagacacatgcacacgtatgtttattgcggcgctattcacaatagcaaagacttggaaccaacccaaatgtccaacaatgatagactggattaagaaaatgtggcacatatacaccatgcaatactatgcagccataaaaaaggatgagttcatgtcctttgtaggcacatgggtgaaattggaaatcatcgttctcagtaaactgtcgcaagaacaaaaaaccaaacaccgcatgttctcactcataggtgggaattgaacaatgagaacacatggacacaggaaggggaacatcacactctggggactgttgtggggtgggggaaggggggagggatagcattgggagatatacccaatgctagatgacaagttagtgggtgcagcgcgccagcatggcacatgtatacatatgtaactaacctgcacaatgtgcacatgtaccctaaaacttaaagtacaataataaaagaaaaaaaaaagaaaaaagcaaagaaattgtaaaatgttgttctatcagaaactcggctaattatttttaaattttagatcaaaaactcaactagttttaatgtactacttataagtcagataaaatcattttttatttttgttttctttttgtttttacatctgttagaaacgatggggtcttcaaagtaaaagaagagatttgcaatgcctataccaaattagttattttaggatactgaatgaaatggttttctatactcaataaaggtaaaagaataagcagaggtagatctggttttctgaaacttgaagcacattctaatttggcagttttctttaagtcaaagaatataacaggacaaatataaaattaggtatgaacatgattatagaaagaaaggaaatcataacaaattatacgtttttaaaaagatgacagataaccacatacatcacaaaaattgaaaaaaataagcagaatgttttcttaataatgaaccatctctgcaatactagaatatacagtgtctgaaataattttttctatctttctggatgcatcctctttcagcacctcttcatgtgagagcatcagaaaataatttactctttcccccagcattgttgattaaaatttgacttctatcattgatagtttagaaaagtttattttacattttcaacttattattggtgatgtcacataaattattacaatttattgtccaatttaggaagaccctgccaagtttctttcacatatgaactgtaaaatttaaaagatcattcaagttatcttgtacaataactaatacatatttttcttttagtcatactaaaccctgatgctaaggatcacccaaactttttcagggaaagaagtagcttgcaaataaatcaaggaccatttatccttactttttggaagaaatggaaaaggataaagtgttagtttaaatacactcaagaacagaatgtaagacaagaaattggaagcagagaagttcatcctcaaatgtaagagtgaaagaatagggttaatgaaacaggaaaggggaaatccaagaaaaattatgccgcgctttagagaatctcctaagcacagagatattggcaatgtgcagatgaaatagctgtcacaggtcagccatgtcagaggtgattccagccactaagtatctactgcagattagatatttggaaagcagaatgagctctgttcatgccattactggggcttgacttcttaatggtttcaagtccccctttgactctaatccttctaaagtcaactttgtataaactcttttcaaaagtgtttatccctgtagaataagttcaaaactccatgtcatggcacacaaaactcttcaaatcatattcagctggtattgttttcttccacattccagtcataactaggatcccaagaattagcaaataaaaatatgaaacatccagaattctaagcataactatgtcccaaatactacaacaaaaaatactgaaaagtatcgattgcttatacaaaatgtaaatggtatcctgtattttataaggcaaccctagtcataagatctctttcttcttcctcacacactgtcaagcttgagccaacagagtaccttttaatgggctgcgcagaatagctttcgatagtttacccattaattaacagaaaattcaaatgagatatcctctgtgaaatcatccttctctcctgcctcctgtctctccattctttctccaggagacagaggccctccagactccatgactttgtagtgtattgtgtctgtctttattagagtattcatcacttggtaattgaattctgtgtttaaatacattttttttcttccagaataagtgttcatagaagggagggatgatttacctagcatactgcctggcatataaaaggccctaaataatttttcttttaaccagtaaccaactaaccaattcaacagttttttaaatgagtgaaaccactttttaaatttttttttaaattcatgcttcacctgtaaaaatatatagatgaattgcaatctggaactctgagtaatttatataaaagtgatgaaaaagaccatggcttcagatttgttgttttaattccagcttcagttcatacaaacattacaaagtcgcagtatctactgtgtaaaaagtttcatcccaatgaagaaattaaaatgtctgtctaatagagatgctctaatggacagcgatgtgtagacttcagaagaatctcctcacacagccttggaggcataagttgggaacagagcaagttctgtgtttgcctttcaaaggaatgttcctttccctttcattgacaaatattataaagatgccccaaaacttctgtgagtttcccccgggacgtaaggtcctctgcattttcctaacttgtttctcaaagcggtggttcccaaggcctgagaatagctgtgtctcagctctctcctggaaaccagagcctaaaatgttgccacatcatcgggaatgtagctgcatacttagccagagccaagagatgagccccactcgcaaagcccatgggctggacaaaattgttagccatttggtgtaggtcattgcactaggtccattacacaggttatctggcaggagtcccggctttggaggaaagacgtttaaatcctgtaaataaatggctggaacaccatggcagttgattgtgttaagccctcatccaaaattgctttgttaggttctattctattgctcattatcttgctgtgaagaaaattaagcttacatctgcttagggtgacagggtatcctgttgtcacaggattttccacattttaggcctatgtcacaagctcccaataaaccctcagagaagatcttttgtgttcacaggcatccaggtgtcaggcagacacagtctttgtcttcttgaagctcagtgacacgttcagggctgtgtatactcctccattccctgccagagacaaaatgtttgtggaacagtcaagctagaagggacctcagaattaatctgatcaaatgtctgcatttttcagttccaaggatactcagggaaggccctcggattctataagtagcggtagaggtggtattagaagtcaggttgcctgacttccaaacctctgttagttactgtcccttcccctgcatgcagcactagtgtaatccctcaactctcacttccctttttcgccacatgcctctctctctttccttcccttgattaccctgcctatccctcctacaagggaaactaccaccaggcatcctcatctgagacccgggaatggaggccaggtcttttccctccctccctccctttcccctttttttgtgtgacagtaacattattcaagtacagctcttccttttttcagtaccttccccctcagaccagaagttaatgaaaaatagggttgcgtgatatgcagcctgggggccaaaaatgtaggacaagcagtgtgcttcagacaaaactgtagggttctggtttcatgcacaaccttggaggacggtggctagaggccctagtatgagagatcaattaaacatggaggccagaaattaaccacatgggattaacatacgtaaggttgcttcttttcaatgagtctaggaaacacactggggacaccttgttcaagacaagctactatttgatgctccttcatacgcttgcttaaaatatttgttcagcatttatttagtgggggcaagaaaaattgatgttatgttaataagaaaacctctttacctcttaccttttattaaaataatcaacttagaagatatactaaaactcacatgacttttgacatctatggatgatctttcatttaatatttttctgctattcctactatagaataaaagctgctattgcattattacagagcgtaatgtgagccacatatgttattttaatcttaatggccacattaaaatagtaaaaataaacaggtgaaatttatttggattatatgttttatttaacccagtgtatctaaaattgtatcattttgacgttgcaatcagtgcaaaaatacagtcatgctatgtgtaatgaggttttggtccatgataaactatatatacactggtgatctaataggattataatacagtaggtttaccatacctttttctatgtttaggtatgtttagatgcacgagtacttgccactatgttagaatttcctgtagtattcagtacagtcacgtgctgcacaaatttgcagcccaggagcattaggctatatcatgtagcctaggtgtgtagtaggctatatgtaccacctaggtttgtgtaggtacacactatgatgtttgcataaggataaaatcacctaatgacacatctctcagaatgtattcctgtcattaagtgatgcatggatgaattaaaatattttggattctttttttttttcagtactatgccttcggaatccaatatgtattttacagcatatgtctattccaaataggcatattctgggctgggtgctcaatagctacatgtggttagtggctaccatattaaccggtgaagttctatgcccatcaaggctacacgtaatttacagggtataatagtattttaaaaattaatttttttctggcttttatgttgacatatcgtttccattttttaaatttttgttttattttctttcactgctttggaaacgcacaacttcttggaatgcaaattaaaagatatcaaataatgatgtagataatttgttattgctaaatgtctaccacttgaaatattcaagtttcaaatttcagctaactgcgattgcaagcttcagctagctggtcccagatggatggcccagctaaatcagacatttgtacatactggctacaaagtgtcccaaaaacagaccaggagggtcgtggatttaaaaaaatttccaccaaaggatgctgtcttgtccattttccaatttgggtaaattaatggatactgcatttaaaagtttttttatttctcgtacattgaagccctgtactgcactcaccaactcacccgttaaagcggctctgaaatacaggcaggaccaagacttagatggactggaggttgggccacaactccttgaacacctagagcagaggtcagcaaactttctataacggtccagatggtaaatgttttaggctttgcaggccaataggtctctgccacgactacttaacaccgctattgtggatcaaaagcagccctaatacgtaactacacataaacgaatgggcatggctgtgtcccgtgacaatttacttggggacacaaatttgaatttcatataatattcatgtctcacccatttattaattattttcagtttcttcaaatgttaaaacaattgttagttctcaaactgtacaaagacatatggtggctgaatgtgacccataagccatagtttgctgccctctgcccaagtctcctgttgaaatggggttatggcaacaatcctcgcagaatataaaactattttggcacctgacttttgccctgatttttttattgtttccagagaaatcaagtatttttctttttcaaatttatatccatattctctttttttctttgctctcttctcttctggccagcaggaagagaccaacccatctttgaattgtattcactttcctcataccgtcacacagctagtaaagctacaacttcacatatgccaatgccaactcttcccgatgttgtgttcaaaacctttctaagcatcaccattcccaggagtagcaattctatatgatattattattttacttgttggtaaggttaaaagttccagggatactgattttcttctttgttagccatgtttcattgagtggataagcaatatgcatttgcttcatagtataaataacaataatgcatcaaattgcaacaatatgaatattacacatagaaaagataaatgtgagttatgtaggtcatgccatttgatagaaaattttttttatatttatatgtttaaacatgacaataaaatgattccattcagatgaaggcaaaggaataggatttcttttcagtgtggtggttttctatttttgttttgttttgttttgttttttagagaatgagttttggagaaaaacaagctttctagacagaaaatattgaaattaaaaccagcaattcatggtcatattattgaaactatcaaattggtatatatatttgaacactactgattattttctaaaatgttacgctttcaaaaaatcatgaagattggcaagttttttagatgcataagcaaatagtgtagtacggcttgtaacactgttcaagataacttttttataatgagtatggtctttctctgccctgtctaatacaatgtgggttttgagcattggaaatgtggtaagtgcaactaaggaactgatatttaaattgtatttaagtttaatacatttaaatttaaagttacattttgataaattgctttgtttttcttttttctttctttctttcttcttctttttttttttgttttgttttttttgaaacaacaatctcactatgttgcctcccaggctggtatccaactcctgggctcaagcagtcctccttcctcggcctcccaaagtgctaggattataggcaggcaccaccatccccagctaaattgtttcttaaatgaaacttctgaatttgaggatacgtgattatgtggtgtagttttccctttctttccccccctgaaatccatattctgaagtacagtgatttatataaaagtaaaaagaaggagactgttttttttttttaaattctattaagaaaccaaattttaacagacacctcagggcctaaataaatatcaagttattgttatttgttatggttcttgttgcttgggtaaaactgtacagatcatgacttagttttccttgaatttttatcaaacaaatgaacaaaatgagcaaacaaaaatattaaaaatgatatttcctacgaatccaagggacatttttctgtatcagccaggctgatgctaaggtccttcaagcaaataagatcaaagatttctgattggagagtgtgggaataaagtagcccttgtttagtgctactttgtagagcctttgtttagagtacggctgggagggagggagagagggagaaaaatacggggttaatttgtaacaacacattctgtggtgtgcgtgtgtgtgtgtgtgtgtgtgtgtgtgtgtgtgtgagagagagagagagagagagagagagacagagagagagattaaattacatttaacttctttaaattttattgtcctcagggtttaaacagtatgtgaccaaaatcacattatttagtgaagagtttgtgggtaggtggatagttagatgggtataaatccctataaaatccattttagaactattgaggtttgagcaaatcaatgtcacctattcacttcatttgtctaatgcctccaggagccattaaagggcttgttacctaactttagggtaggtttagatcaaggtgaacagtcagaaaatattatccatgtactcacgtatattattaagtattctttgaccatggagttagatgcttatactgcaaacaaataaattaatgaataacagtgctgctcatgaacaccaaagtttactgaaaagtcaatatggttttagtgtggtaataagggcagagttctccaaggactgccaacctatttattgtacatcaaattttactgactttgaaatcttgctagaaatgttcatttacctcgtaatgtattatatgtttgaggtcttgagaaaaataacaaaatccatgtgtggtaatgaagtggttatgcaataaaactaacatacactgtgatttgacacaggggacttcactgttatcagatacttaaaactggaaacaatgtaggaaatatagatgtataagcatcgtaagtaaaatccacatgctttaaaaaggaaatccacttacttttaaagtaatattccgagagctatgccactgggggctgaatgtcataaaaatgatttgtaattagtcacttttacattgtatatggatttatagttttaaaatatctggtggcatataaccacaatgtatttttcagtcatatattcatcattattttattaaatttccagagggaaagaaaataaatgacctcctagtgagggatattttaccacgagaccagttgtaaaaataatcgagttttgtgcctgggaagatatctttgctaagtctagttctccagtgacattaatttattgttgttaagaaatgtgtgaggcaaaatgaactctccaaatatttcatactacgtgcattttatccaaaagaagataatggtttacatgaattatttaattggtattactaatttgggggaggtgatttttggttgggggcaacagaatatttgcctaaaatgcattcagagtgcgctgttatttagctattttcaaggtagagggatattggcattggagacttacacgtagccatacaatggccaacttcagtcaactacagaagcaatacagggcagcggctggaacaaaatagctactaggtaaatattgattgaattaattacacggatattaccactagtcctgcaattaattaatacctagccctgtctccagccccagaatccatgacatcaagctaactaacagaaaacatatcaagaattttattccttagtcctcttgactgaccctcaagagggtctaccctcttctactctgtattcctcacatcaaatttcactagtccagccgccaagtaacacctgttctgactgtgctagtgaacttggatattcacacatagcctaaaatgggaaacagagttggaaatgtcatgtataaggacataagcgttttcaaagtgtacaagaacataagcgtttttaggagatttaccttctcttttctgttttattagcgaatgattgattgttttgtatgattgttcatttaacaaatgctatatcatgtaagaaaagttactaacggtatataaagatgtaaaattcaattgtggctgtgtgtatgtgtgagtattctagcttttggggagagacaagagaagaaagaagacataagttggaagagaacagtaaaataaagaaaaaagtaataactgacggtgtctaatgaagtagcccaggtaattaatgctagagtttattagatagaatcattatttccttccagagggattaagcaatcttctctgaggaggtggaacttttattacccaaaacatgaaggattgggaagagttttatatgtgtcgataaggaaaagagatattttattgagggaaaagaagacattttaatggcagagtacacaatgtcagaggaacagaccaaaagaagtgctttgttattaggaagatttgaagaatggaagatagcgtcagattgttaagaaccattttttagataaaggcaggctaaagaagttggaggctattggaaatcagtcacacaattttaagcaagagaatcaatgagtggcagttttgaaaactgaatttgatagtggcaaggaaaatagggctctatcatcccacttactttcaaagttatgaagaaattgtagtaagctccagtcagtacctaaaggaatttattttgtgaaattgtgtaaacaaaaagcaaaccttcttttgcactcatatagtatattttctcaaagtcatatagctaaagggaatgagaggtaaaatagtacagtggttaacaggataggcttcaaagcctaacttcttgggttcaaatcctagcttggttaccatttcacagctatctgaccttgtacaagtcacatgcgtacactgggaacaataatactacctgtattatagagttgttattagatgttgttgatagatatgttgggcacattttaggcactacatacataaacctctttctatagaagtatacatgtgtacctatatttaaaataatgattttcttttttaaaagaagcacatattcattgcagaaaatttttttgaaattttaaaagtaaaatctctggtctaagtgcactaaaatgttttagactttagatatgaactacaaaaacctacctcatcgacacccaaccccactcccagagatatttcattttatttgcttgctatcagtaatgagaagacccaattcaccacacaatttctgttgtatgagactattgtattgcagtgcaagatagtgttttaaatctttgttaaatcaataggtgcaatattacacctccctgtttgaattttcctagtgaagtcaaacaattttaataggcctatacataggtcagttatagttctttcctaaatggtctattcctcattatcctttttaattgagtatttgtctttttttctactgatttgtgagaatgtttttatcttaagagtgtcaaaaagatgaattgtttttgcctttttctttggcttgtttgattttttatgtaaagaaattttatactgctatgaatgtaagtcattactttatggcttttaaattaaaattataagaatagcctcccatattttcattacttttatagttcaatttttttacatgtaacatttcattcatctggtatttagttaggaattgtgtgagataggattttaaaattaagttaaaattcaatcaagtctttattttttaagtacagaagtttccgaattcagcatttacattaaattttttgaaaataatgctaaaatatcatgtaaattattacttattggaattgaaaattccctattattatttttaatctttataacaacttatgttatctatgcttctattataaaataaatgacaagccaaccaaaatagagaagatgcttatcacaattatatcatgataatttaaacatgattttggattaatcataatccaaaaatgcatttgataagcattctaactgttcttctagtccccataaaattaacaaatggcaaacagtaatgttttaattttcaaaatattcatattaatattcattttcaaaatatgtttacttgcatgcatttcatttatattatttcttattgaagttgacttctcaatgtatattgctttaatgatactaagtattaagggtatagattgtactcacacaaataactattgaaaagcataagtttaaatagatccatttatcaaatgatgtctttttttttcttttttttttttttttttttttttttgtgagacggagtctcgctctgtcgcccaggcaggagtgcagtggcgcgatctcggctcactgcaaactccacctcctaagttcacaccattctcctgcctcagcctccagagtagctgggactacaggtgcccaccaccatgcccggctaattttttgtatttttagtagagacggggtttcaccgtgttagccaggatggtctcgatctcctgaccttatgatccgcccgcctcggcctccccaaagtgctgggattacaggcgtgagccaccgcgcccggcccagatgatgtcaattttgaaagatactggaaagtatgttttgggagggaagagggaaggaaagagtagaatatgaagtcagtaaaacctggatatttagtgccatctttgttacttactagtaaccttatgaatattatttatattgttgatccttaatatcctcacttgataattttagaaaatgttatgtacttcataggatcatgggtagaataagaaagtgaatataagtaaaatccatcatgaagtacctgaaatatgttgtaaacctaagttataatagtaattttattgttgctaatatttcagaggaatagccaccaaaccagtactacttattatttatttctatttaacatataaaacatataatattctttctgagtggtaactttgaaaagggacaaaaatattaaaaattacattaaaatcatgtataatttataatactcctttcaaggttactaaagtgtgcatgtatttctaatcattcacaaatatgaaaatctatgtgtaaatttttaaattttctaaaaaattgacaaataaaaattgtattattgtcatggtgtacaatgtgatattgtgaaatatcacatattgtgaaataaacattgcggaatgactaaatcaagctatagaacatattcattaccttacatacttattattttttgtggtaagaacacttaaaatctacttttagtaatttccaagtatacgttattgttactaacagtagtcaccctgagttacaacagataactaggatttattcctcctgtcaaactgaaattgtgtatcttttcatcaatatctcccaaatcaccccacccccaggatctaataaccaccatttttctctgtttctctgagtttgacatttttagatttcacatataagtgaaatcatacagtatttgcctttctttgcctagcttatttcacttgacatcatgtcttccagttcaatccgtgttgttgcaaatgacaggatttctttctttcctaaggctgaatagagttccattgtgtttatataccgcaatttctttaaccgttcatttattgatggacatttaggttgattccatatcttggctattgcaaatagtgccgcagtaaacatgagagggcagatatctcttcaaaatactgatttcagttcttttggatatatgcccagagataagattgctaaatcatatggtagttctatttttaatgttttgtggatcttccatactgttttccacaataattatactaatttacattcccatcaacattgtacaagggttctcttttctccacattctggccaacacttttcttttgtctttttgataatagtcattctaacaggtataagatgatatcttattttggctttgatttgcatttccctgctgattagtgaggttgatcatttttttttttcatatgcttgttagccatttgtatgtttgctttagagaaatatctattcatgtcctttgctgtgtgtcgatactgatatgtaaaatatgcatacaaaatcaaaaccataatttatttttaatatatttttaatatgtcattaatatttttcagtgtaataggatgtttttcataatatttactttaatggacgcaacatatttcattatgtaaaagcagtttattctatttggggagatttcgtttcactttttcgccagagtgacataattgaacattcttgtcataggtctctgtgtttatctctgatattcccctaggaaaattcatagaagtagcattttggagttgaagggaatgagtaatcttaaggcttttaaagtagttttatcaaattttctaaactgaagtataaagacacatagaaaagtacacaaatcataagaatagaaattcagggatttttaaaaaaaacttagtgtatccatgctactaccaccaagttcaagaattagaacattacctcaggagcccctctcatgttccctcccagttatgagcctctcccctgccaccaccctctcccaaagataagcactcttttgacttctaacacctagattagttttgactttgaaattactataaacagaatcatccagtatatgcccttgtatttgacatgtcctgctcaacattatttttgtgatattattctatgctattgcctgtgccatagttagtttagtttttctatgtatggtattctattgtgtgaatatgccacagtttatccattctgctaatcaatggacattgggctgtgtctattatggggctattaggaaaaatgctggtgtgatgttcctgtcctttgctgcatatatgtatatatttatttttaatatacgtggaagtacaatggctaggtcataagatgtgtacatttggctttggaatcaccaaaaaacagtttttcagtgtggtcatttcagttcattttcaccagcagtatataagacttctagttgatccacatattcatcaagagtatgtattttcaacctttatccttttaaccatttaggtgaatgtgaaatggtatttcattgtgttttaatttgcaatcacctgacgattagtgccatttttatatcctcttatgtgaagtcattatgcaaatcttttgcccattaaaaataatagttgtctttttcttactgatgtagaagttatttggatacaagtcctttgtcagatctatgcattgcgaatatctttttccaacctaaactttgctttatttttttctcttaacaatctttcctgataaatggagtttgatttatcagtcttttcctttatggctaatgctttttatgtcttgtttaaaaaataatacattaacctaaaattgttgagatttttttctatattttcttttgaaaactttatttttttgccttttacattgaggtctgcaaacaatctagaatttatgttttgtgtatgatgtggagagtcaaggttcatgtttttcaaatgactaatcagttaacttggtgctatttactgaaaagatcatccttttccaacttaagtgacaccatcgtataaattaggaaacgctatatagatgatttgttctcacttcaatcccacacaggcttaattataataaatattcatgtctggtggcaaacattcttaaacttcgtcgttcttcaaagttgccttggatattcttagccctttgcacttacatataaatcttaggattggcatgtcaatttctactaagaaatggttgctgcaattttgattgagattgcattgaatttatagattatttgaagagagggcagatatctttacagtattggactttctaattcatgaagaaggtagtcctctatttgtttacattttcttcactgtctcagtagtgtttgtagtttccagggtagaagcttaacttttcggtctgaattaccaaattactagcaacatatatagtcatgcatttcttaacaaatgagatatgttctgaaaaatgtgtcattaggtgattttgttgttgtataatcatagagtgtacttacacaaagatagatggtatagcctactgcacatccaggctatatggtacagcatattgctcctaggctacaaacctgtactgcatgtgactttactgaatactgtagtcaattgtcacacaacaatatttgtgtatctagacacagaaaatgtaccgtaaaaatacagtatacaaatgataaaaaatagtacagctgcatacggtatttaccatgaatggagcttgcaggactcaaagttgctctgggtgagtcggtgagtgagtggtagtggtgagcaaatgtgaaatctaagacattattgtacggtaccatacagtttacaaacactgtatagttaggctgcactaaatttatgaggacacatttttatcttttttttttttttttgtatttttagtagagatggggtttcaccgtgttagccaggatggtcccgatctcctgaccttgtgatccacccgcctcggcctcccaaagtgctgggattacaggcgtgagccaccgcgcctggcccatttattttcattaatgataagttaaccttagcttatagtaacttttttactttataaactttttttttaagtttttgactctgtaataacacttagcttaaaacatgaacacgttgaacacccgtacaaaaatattttatatccttattgtagcagctttcttatttttaatatttttgctgtttaagcttttctgttaaaaagtaaaacacaaacacgcacatgagcctaggcctacatgggtcaggatcatcaatatcactgtcttccacttccacatgctgtcccccactggaaggtcttcatgggcaatgaaacattcatgaaactatcatctcataggataacaatgccttcttttgaactaattaagaatatagtaaatacataaaccaataacagttgtttattatcattatcaagtattgcatactgtacatacttgtctgtgctgtatttttatataactggcagtgcagtaggtttgcttacaccagcatcaccacaaacgtgagagtaattcattgcactgtgacatcactaggtaataggaatttttcagctccattgtaatctcataggatcacagtcagtctgttgactgaaatgtggtgaatgactgtataatagggctccaaggaagatcataaaattgcttgttttccagaactttgacaaagaccttttacagaaactaatataatagataaataatagtataacattgctgttttcctttgcatttcattgattactaactgtctggattttttcttgtttattggctgtttacatttttgtcaatttctttttatgttctttatccagttttccagtagatttttcctttttttactcattaaaagatttttttatatgctaaaattattaccctgtgtctgatatatgctgcaaatattcccagttgtcatttgttttaattttgattagtggctttaatttataagtgaatacgcatattatattcaatctttttatattctttttttgcttctaaaaggcttccccacgccaatattttattccagttcttcttactatttttatgcttaacactttaatttttctaaaatgttttgtgttatgaaatccatcttaatatgtttatttctaaaacagacacttttgcttatcttaatattaaaacatatacatttgaaattaacattcagagattgaaagaataaggaaagtaatcttgtgtgaaattaggtcaagatgtgcttagatactaaattaacacataagggaattgaatgtgtttgttttctttcaccacagggaacatgttatatgaagagcatggttttataatacataaaaggattattagaaaaatgatgtattttaccggtcaggtgtttgtgtctatactttgatgtgaatgcaaaatagtaaatataaatgtaaattaatttaaaacacatagaatctgatacaaaccttaatctttttccacgttatacattactcacacctgttatatttttccgtgaagtatttggaatactctcgattcctggaaactgttttaaagtgcagaagagcacaaaaaaaatatgtgttaaaagttcttgatttccacccaaccattaagtgatattgccaaagaaaactcttcagagcatttttcactgatggctttagatatgttataccagaataataatgattcattattaaaatatgcaaagtgtaatttctcaacaacattttgtggtaggaagatgagctggtacagtagttttccttattaaataattttttacaaaagtaattgacatggtttggctgtgtccccacccaaatctcaccttgaattatggtaatccccacatgtcaagggtggagccaggtgcagataattgaatcatggaagaggatcccccatactgttctcctgataatcagtaagtttcacaagatctgatagttttataaatgtgagttcccctgagcaagctctcttccctgctgccatgtagaatgtgtttttgcttctcctttgccttctgccatgattgtgaggcccccccccgccatgtagaatggtgagtccattaaacctctttcctttataaatcacccagtctcagatatgtctttgttaacagtgtgagagcagactaatacagtaatgcatttacattgttcaaaatataaaaggtacagtaaaaaatatctcaccctacccatcatctgctctaccctcactgcacattaaccttaattctagaaacaaatctacaaaataaattcctgggaataaaatttccaggtcaaagtttacatgctttttatagatatggccaaactgccttccacaagaggtacacaaatgtatacttcccaccagccacgtagaagagtctgcattttcccacagccttggcagcatagtgtacctgcagacttgaatttttgccagtgcaatagatgaagctctaattttcatttctctcattattaccaaggctaagcttctgttcatgcttttaaaatcctttgtattttcttttctgtgaactgtccttatcttttgtccaattttcttttgggttgttggcctttttcttattactttgcagaaggtctttcatgtgttaggaaaattagtcccttagacatgagtcacaagcatttatttttcataattgttcatttgtttttgattttgcctatggctcttttggtcgtgcagaagcttttgattttttatatagtccagtttactgatatttttgtctgttaattaaagttatttaacttgaggatacaatttacatttttttgtggttgactactatagacatatactgcttcttacattgaaaaaataataatcctgaatttggaaattgtttttaacaaacttttggtgaaggtccatcatatttaggaacagagcttgtttgacccagaaatcaaaggtcagtgagaaggagcaatgtaaatagaaagttaaatagcatgaggtaaatgttatgatggtgggaaagacaagatctgagaggataaacctaaagcaacatcataattaagctgaaaatttcgtctcatgataagctatcatttcattattccagatattagtcaaatctgacccattacactgttttctgtcaggaattgttttacctctattacaaggaagggatagtatgggaggatgataaggaaaccagcagtcttagttaaatgttatacagatttctgtgcttatatatgaagcctaaatgaaacgtgaacaatttcatgatcagataaaaaggagttcatcgctcagttttagagattttaggaaaatatgatggctattatctcagtagcttcagagtctagaggcatttagatgttgttagttgaagctgtaaaacgctttttacatctacttgtgagtagaaaatgatccaataaaaataaaatgtttagttacctcctttaaaatgcttgaaaaataagttgaggacatcattagatcatgtattacagacgtaggagtatatttgtaacatcacctacatcacacatacctgtgtgcgcgcgtgcgtgcacacacacacacacacacacacacacaagagttcagcaccacaggtgtagttatggatgtgaactcacaaaacacaaatcaagcaaagagaacaatatctcaattcatgattcatggacattctgtgctatctgaaacacaatgcttcttttgcccaactctcacccacacagggaaaggctgccaggaatgagaggcaagaagtgtgcaggtcaccttcaacaggagccaccacctgtatttcccatcagtcttttacaccattgtagtcacgtggatccaaggactgtattccaactgacagctcctgcgatgaggtgcagttccacacgacaaagccaggcccaacatttcccattcatcttaaagttagtgtttccaaggaaacagtgctgtgggagcctagggtcagtcccagactgacctgcaacagcccaggctggatgttaatcctttgcttatacagtctcatgaatttttcacaacatatatacatgcatttacaagacgtttcactgtacatattgtttacgtatacaatcttgtttaaaattcatttttctgtacattaattgatttttttctcgacaactttctctttttcatctcctaactcttgcatccaattaaacaatgtactgttcattagtgacttattttaaaagtatctaaaacaattgttccaaagcatgtgacattgtttatgtgacacactggtatattatctagtttatttttaaaatcttctctattattattcataatatattattatggaacagatgtatattataaaattttattcatattgcagtgtaatattttgtattacagtggtattgttaatagtctcgtaaagagctatcattacaagtttaaattctttattctgggatgccagttttaactcttgatattctgaagaaaatagctttactcttgtttattctggctctgtttttttgttttgttttgttttgttttttgttttttttgttttttttttgtagagatgggagtgttgctatgttgtccaggctggcctcgaactcctgggctcaagcaatcctcctgcctcagcctcccaaagtgctgggattacaggcaagagctacagtgctcagcctatcctggctctttatttacatgtaagcttgagcaataatcactgctacttaataactttattgtcattcattatcatgcagagtattgctctaaggtatgttcagggatgacgttactgagtcctaacagtaatcctatgaagcaggtgctatcattgtccccaatctacagaggaggcattgagagttagagaaaacttggctaaaatgttaggcaagaactagaaccagaattgaaatccaagtggcctaactctagacctcacaatgcttaataccatgtcatgctgcttcctaacctatttaatgtttttttcaaccccaacgtcatcacccatgtgtgatagtgggatcataataatatctatgtcgtagcattgttggatggattaaggaagtctacaaatgtgaaacttccaaggatgatggttggcatatactgatctcttaataaaaataacctataatcattctgttacagtctactctaatccaaatgttctttttacttctcatctcaaccacctgcttctgtttactaggactcacaaactatagctcacaaaaacgcataacttaccaattttccttgtacatgaagggacttccttttacaatcttccatgacataaaagaaagctagaagcaagtatagtagaagaaatgattgctatacaaacaaaattatagttggtttggttttaattttaggatgcgcattgaataaaaatcactcatttgggatttagaagacctgtgttatatatctggtgctaatgctgaataacttggcttattcatttttataactgcaaaggaagcgcgtatggcatataatacacaacacaccagtatatttagtaactgagtgaataaatgaaagatgtatttctttactttatcagttgcagttggctatgcctttgtgtaaggtgtgtgttttgaaattccaaaaaggtattagtttctttaaagcaaagaatttttgtagcaggttaatgaataattttgaatacattggttaaatcccaacatgtaatatatgtaaataatcaatattatgctgctaaaataacacaaatcagtaagattctgtaatatttcatgataaataacttttgaaaatatatttttaaacattttggcttatgccttgagaattatttacctttttaaaatgtattttcctttcaggtttccagagctttacctgagaaacaaggagaaattgaagctcaaataaaagaccttgggcagcttgaaaaaaagcttgaagaccttgaagagcagttaaatcatctgctgctgtggttatctcctattaggaatcagttggaaatttataaccaaccaaaccaagaaggaccatttgacgttaaggtagggaactttttgctttaaatatttttgtcttttttaagaaaaatggcaatatcactgaattttctcatttggtatcattattaaagacaaaatattacttgttaaagtgtggtaaggaagactttattcaggataaccacaataggcacagggaccactgcaatggagtattacaggaggttggatagagagagattgggctcaactctaaatacagcacagtggaagtaggaatttatagccaaggagcagtgtaggagtcagtagatggaaaattattaagaggaaacatcaggggtaagtgggattctggctaaaccaacctcacaggattcttgctgaagataggccagggttatcttatcagacaacccttggggaatggtggagaatactgagggtgatcaggtaccaaggataaagggttcttgtaaaactgacaggcttctttgctgaacctggattttacaggggagtgcaaagatgagcccaggcgaaggttcagaagcctgactaaagtttagtcaagcagggaatctttgtcatcatcatcattgttgtcataatgataataattattattattttactagaatatgttgctttttcctcagcatttactagaaataaggtcttcattaaacttatgttactagaatgcctgcatcatatttgttactgtgattcattttctatccctgttttaattgtgcttaatacatattcatagattccttatccaaaattgaagttgtttatgagattaggttcctaaaatataatgtctgggctcttttgtagacattgtaaagccctctcagactgactacactttacctttctatcttctcattctgccagcaatctccccgtatagtctggccacatcaaattacctggtacctttccatccatgtaatttcatgtcatacctgtgatcttggttttctctcttctttaaatgacttctttcagtttattttgatataatgaattttcttccattctttaagaatgaattcaaagtcattgcgtcttccaagttttcttccgtaccccaagtagagttagaatccctgttaggatttcttataaacctttttattcatctcccattgttcatatgttgatttacacttaaattttatacacctgagtatttcattacacatctgcactgttctttgagtgcagagggcattctcttatttatctctgcttctccactcatatcatacacactcagcctaggatccagtaaatgatgcttacttgtgagtgtttttaagtcaatgaataaagacagtaccaagacacccagaatacgaatgagatactgcaggtaagcgtaaggcttcagacaatcctgccaattgaacaccactatctccttcttctagtgtccttgtaaatgctgattgatcttcttttctccctttcaaggaatctattccaaagattctttcaatatgctgccccgttttgcgtctccttatttgccaaaatctttaagtagccaatcaaataaaccgaatcgttgaaattacaatctattaatgaatgtattgttgggcaacttcagagtaaaaaggataagtaacatttttgagtagttttttcttttatttaattgactttaattgttaaatttatttactgtccagtattgtaaaaacctaacattttaatctccatttagctgttgttttgctggaactgagagcaaagggaaaaggaagtttgagaatattctagtgaagaggaagtaaaagtttcgggaagatgggcatgagtaacaaggagatagagggaagtttgctacaactaaaatgagttagattagcaaaatgttctcgactatgtttaccttacttcctcctgacacttatgtctaccattctgatagctactcctcaagagcagatggcactgtggaagtcacaagtagacatcatttcactagcacaaaactcagcctgctcagccagtggcacagtcttgggttcagtctgatgattaaatttacgagacataataggctttacccagtaacaaatttagttagctttaagaaattatacaggatgggtaacaacagcctgcacattaaaggcacagtggaagtcttgataccaagacgtggcttctgatgtcccatcaccctgaattttagtcatacatgatcacaaggggcaagactgggtgcgtacaaaacacatcatcgtctcagggaagccatcagttctaggatcctgaccatttctccacttagctagtacatattgtactcagaggtgtttgactagctcctattcaccagtacaattacatctcatgaatactgatttttcactgctcaataaacaaccccaacaagaaagtacagttacttggcccaatacacaataaccttagccaaattctcaattatcttatatccagtatattcttaaaaagtaactggcgtaatattgcgaagaggaaaggtcataaagtctttcctcccaaccagaaatagctttttgtagctcacggtaaaagcacattctactcttttaaatgcaatctttggttaaaatgtgcctctttattataatagtttaaaaaatactcaatgctagctatctctcttcctggaacacatttaagaaaagatttttttttgaatcccttggtacaaatagatcctgtttactcaatcaaaatgacttttgtcccagtctgtgccccccggaatggttttcaaataatgaaaacctgcattgtgtcttcgattgtctatggcccatagggctctgccaaatgggtccctgcagtttgaagtgaaagccatactcggctgtgttaatcacttttctttatcaaagctacaagtcaccactcactgctgtgtgtagtttctgagagtcatgatatttgcctcctgcagcttgttttaaatcactgaggggagagggagctgcttttttcctggcagaaaactccttggcttcagtcctctgagcacattccgagtttcttatctctggagtgcagacttcaaaaatactcttttagcctttttcttctgcttgtggctgtgttcaaggtggggggaggggaaacataaaatcatagatttgatgacttgagagtttctcccaaaaattctcaaacccccagcttataattaggaaatggtgacctgtgtgaataataatttaccttgttttttatccctctttgtctagcttccattcctttcactaataaatgatttattaagattgcacagtttttctgatttaagatataggatattagtccttacagcctgctgtattcctctgcttaaaggaattaaactatttttccattaaagaaagatgggacactagactttgctttacttagtttcaaactactgaacaccaaaaataaaatttttaaggagttttgagcacatgcccttttttttaacacaaggtaaaaaaaaaaaaacacctttactaaaatcttaagaaagagttaatgcaaaggaagtagatatacgaacagccacgcccctagctccaaatcctaaatgtaaagaaacttgccttgtctggccatggtggccatagctgcctcggaaacaaagggtctgaggccttgccattcgggtagtttgttttctctagtcaaactctgagcacacctgttagaaaaatatgtaataccctctctctgtgagcctcagttttgtctgcttggtacttcactcttattgatgaaatgcagctagctgtgtagtgaaacccagataaaaaaaagctttaagggctgtgttctaatacattgtttatgctggagtgaaaattgactgcacattgcttggtttgtgcaatttactcccgaaatattcctattcaggaaatcctgcaaatagcaatattcatcttgaaaatcacctcacagaacccttagcaagctgagaaacataatcaatgagatcgtgatgtagagggtgaaaattaggcgtaatcacagccctttcccatcagtcagcccactagaaggcatgcctttgaattttgattttcaaatatactctcaatttagacataaaatatgttgatttcagatttcagaaatgataattgaatgctaagatcccgggaccagtttagaatttctataaagggtcttatgtttttaacctttaatgaatgctttcaataatgagctagaggtatactatttatctgacataagactgactactgctttccaaactttttattaaaatatgaggtgtggcgggacacataattttatgttaaggcttagtgactgaaatactttcatcttaatcacagggagggggttttttcctcccctcaagaatcactttccttctgtggtttataaataaacatgacatgtggctctgctggctcttccttgcagtataaggagcataattgcccataatgtcaaatccacactaaaaactaccaaaggactcaattgtagtgactgaccattaaagtcactgaacactgtgtgtgttcacattgctgtgagtgttgtcaaagaaaaatagcactagacaacagacaagaaagactgtgttcaaaacttttgcaatagaggagacagattgaactcaattctgctgaaataaaaggcaggagagcctctaagtgctgagatgagttagtgagaaagtactagatatcaggagggaggttagtcaatgtgcttatttaggccatctgtgtttgctgattggcacttatcaaagttagattcctatcctcccaacagaagactagcagattggggcactatcttttttgatgattctatatcaaagtgctagctcccaagtccttgagaaagtttattcctgaggtataaaagtggcaagaggctaggagaatatttttgtctcaaaaaagtagagaaataatatataaagttttctagagtaaatgctctaagaaaaggaaggtcaggtctaaagtcaggaagaaatctgtctcaaatgtagtcaaactcagggtatttttaaagctttctttgtcaaccctccattttgttcaagggaaaccagttttcccattgaaaaacttaggaacgccagttcatctagttcatttcagcaggtttctgttgttgaaggactagctgaacgaactctgacacttggtagtaatcagacatttcatgaaggagatttccatgaaagttagaaggaagacgaagattaatggttgaagcagactgcaaactcagtttttgagtccagagggcagcaagtcaaaaagattcctagaagctgggctgtaggcattctcagatggtagagtgaggatggcagtagcaatccgatggatttcttggagcatggcacggaagaggttggagtttactgaactttttgcatggcctacaaagcagcagctccaggcatgaaagttgtctatacataatttgctgtggtggtgagtcctttgtagtttatagcaagtcatccagcttctgcttgcagggcttctttagatattgtggggaaatggcagctataagacaacctagagaagagagtccttatctcagtaataatatgggcagtcacgttttagttctcagtgtcaccaagtcaggatggtgggagaaaaatttgaaatgttaatttggagaatcgcagccagattgtaaaggaaataaactgaaaattggtaaggacggacaaaatgtgtaagacagcaggatccagatcaatttacaggtaggtaaaaaaaaaaaaaaaaaaatcatgtcgtttacaaagaaatgcaaaatagatcaaagacaatgaacaggactagaatctgataaccccaagggttactgaaactctatctctaccatcacccttttgatcagtgttaatcaaagtaagactttccttgtttataaaataagactggcctatttatttatataggggtagcaaaaatggtaatttaccaaataggctattttaagtgtgattagctggaagttttcatgaagaatcacaagctgaataagtttcagagatatactgtacagcatagtgcctatagttaacgatactgtactgtacaattagaaatttgctgagggcagagtttaagtgttcttaccacaaaatactactactctcttttaggagcagtggtacataaggtgagaggaaacttttggaggtaacgcataggtttatggcatagattgtggtattggttttgtatatatactttatctccaaactcatcaagttctatgcattaaatatgtacagctttctgtttgtcaatcatacctcaataaagtagtttaaaaaatatgaaacctcagatttgattttttaaaagtctccaaagtttaggaaggcaagtcaagaacttgacatcagattttacctgaagtaaaatacctatagattcagctgaagtgttctgttttccaggttcctaaaatacccttggtttcctgggtctcctaagaatagaccttccttactcagttgtaagattgggaattctgtaagccaggtaccgggacagttttcccaaaaggggcttatattagctccatatagtcaagagtagctccttaaaactggtcacatctgactctatgcacttaattctcaaatatgacattccagtcaaagccttggttatatatttttttcaattatgtcttgttacctaaatatatttattgagcctatgcaaataattatattgccatgaaaataagaatactcggtaagaatttctgaattttacagggatcaggcagggataaaaagattaatgtttcattctgtttacaaaagcatactctaaattctcatgagttatagataacttaagagaaaaaggaaaggcgtttcttgtatttagcaaacagaacattaaaacatgaggaatattttaaacaaaagccataatcaaatcttttatcagttcattcaggcccatgtagttaattcttgtcttgcttgatcttgagttagtagtttcatgaactcatcagcttcttcacagagtttcataaatcctgactttgtccaatggtataatctcgaagttatttaagcaatggcatcagaagtctgtgtcccagagtacctgtcgtagtacttcctatgggtctcaaagatggtcctgttttactgaagatgatgcattctgacctctaactgattgtaagagcactcagggaagcatcagcataaaccaaaaactatctgtgaacgacaaaagacttaaaatggccataattaaagatctgattcattcgacaagaaattttttttttccctggtgccatgccacattttaaaataacaactggagttaggactgatgacataatattattatcggataaagtagcaccaggatgtgtcatggacacctagagcacctagagcactaacaaagttctaaggatttattataatttttcaagtatttatactaataatagttgacccatacaactataacctagtcaaggttcagcatctcttcttgtcaaagctttttatgcaactcaacataccaaatgaacctagttatttttaacatccttcattttacaagggtgcaggaacaaatcctttgaaatttttcaaaccaatctgagattaaaaaaaattttatttaagaattgacctgggaaaagcaaaatatcaaaggttgtaaaatgacaaaaggtttgaatacttggctgaataggatcattgctcactatgaaagaatgcatggctacctatgtaaccaagatgacaataaaagatttcaaaaataaatgtagaaggccacatgacggtaaaagtttttagttctttccaaagagaaaacactactttctaaaaaaattcaaggacatacaaaatcaacacaggtacttattctgataagaaacaatatttgtttcctatacagattacccaaaatataaaaaaaaaaacaaattttgcaatctcttattaagagaagaccaatagaaaagatgaaaatgttaattagtttgaccgaaataattgttttgcaattttgtgtgtgcgtatatatatatatatatatcaaaatatgttgcatacttaagtatattcaattttatttcaaaagagcagaccaataatccaagaatattttatcattttttaacaaaaagaaactacaactcatttttgatcaatacactgttgatactaagggtcatttgtaagagtttacatacacataaatccattccgttttagccagcattggctattaacataagactctccttccacaaatcttctgccatttccaatgttcattcagattttgtcctataccttcctcttcctcattttcacagtcattttaatttaggacaaagttattctctttttccttaacaaaaacacatccaacataccttgtatattttgcatacaaagttgtttccctttacccctaatgtttctggaagttttatttacatatattgattatatttttaaccattagtaagtcttattttatagagaaaactaggaattagctaagtgtgaactgtttgtcatataccagtatttcatagccaactagcaaagcttatgaatacaagttaaattcacctactcaatatgagggctaaaagtttacatcaatatttgtggaggagccttttaagattttcttttgccctgatatgtaatttatggaggctgtgttctaaaatttgagtaaatgactgaggagatacctagtggccatctgggtatctccaaatcccatctgaacgtacacggtatccagtctgtttccaattagctttttcaacctcaggtggttgcttctggggtttgagttttccagagcccccagtagtggcagggagcataacgctttagagaccatagagagttgagagactggagtaggaagagaaaggtctgtcatggatggacaaagagatggagcaggtacgggtttgaagaggaatatgctgaaggatttaagggagctaaagggaagatcaaaagtagtcaaaggaagaaggaggaatggtggtgatgggaagggagaggtcttagatgagccagcttagggagtgcttatgttttcggaagaggccattgaagttcatctttagtaaaaatcaaactaacaagaagagaagcctagtttgtgccatagaggtgaagcatctaatcagcagtagtcttcagaggaggagaaacagaatagtgagaatgtctcctggaggaaagaggcaccgaaggaacagcaacaacaaaaaaaggaaacatgaatgaggtctctacaaacgtgatctgtacagaaaatgatttctctaaatactgaaaatctgaagttgaaccaaatgagatttcaataagaattttccatgttctaaaccaatgatgcttttcaaacaaagaagcctgggactctagactcaagaatatactcagattactgagaatcaaaatctgatgttaccatgcttccacgctttcgtgggtaaggagtcagacttaccaatggattcccaattaatcagtcaggagtgtactcaacattcacaaaattagctttgcagaggttaatgtcattaaattcactttagaatggataattcaaattcaaatagtaactcccttagatagatgtgtactagctcaagttcacctgttatctgatttcatttttaaaaaaaattttttaaaagtggtgttcgggaggtaaggaacaaggaagagacctttagaaaaaagtttcagtgttttatattggatatgaaaatatcagtggaatgtgtcctgaaaaacactggatgacagttactggacaaaaagacaaattattcccttttaccatgcaactgaacacagatttattgaatgtttttctcctgagtttaggttgcctctgggcaagagtataattctggcttgataacaccttgaagcgtgtttgtttaagtttgtggatagtttcatctattagtggaattaggcatctgcttctctttatgaacactgggtaccataatcttcctcttactttttgttttttctactcaactccaaaaaccattgctgagttgaagtagaataataaggggaaagaaacaaaagactaagtttgaatcccagtgctgacacttactggctttacgatattgtttaactcacttaccctttttaacctgaccttcttcttcactaaaaatgaaaaattgagtgaatttccctgggactctgttagataaggcaaaactaagatgggaacacatttcctaaggcgtagaaaaagacagtgaatgggacctttcttgttgtatcaggagttatggtaagaggtactaacaataaaaattaggctttcagccaggcatggtagctcacgtctgtaaccctaggactttgggaggccaaagcaggtggattgcctgagcttgggagtttgagatcagcctgggcaatatagcaaaaccccatctctactaaaaatagaaaaaattagccaggcatggtggcacgcacctgtagtcccagctacctgggaggctgaggcatgagaattgcttgaacccaggaggcggaggttgcagtgagccaagatcacaccactgcactccggcatggggaatagagcaagacttctttaaaaaaaaaaaaaaaaaaaaaaaaggccttcaaaatacccctacagcagcaagttggtaccagaaaaacactccaaaaaagggagtagatggtcatgagattttcatcgttcaccaacctaacttgcccatataaggaaaaggataaacttgagaacagtttcttgaatgagaattcctggaacagatcattcaaataggactaacaatttgttggacatgagaaaacttctatgacttttactgttccctttcttatgagggaggggagaagagtgcttttcctctttgccaagccaaggaagagggcttcaaagaacctctattatagtggcattcagaccattgtatttataaaaaataaaaatattttagaaaattgaatatctgcttgcacattttaaagatgacatctattttctgcccttgggatacagtaaatattgacattttaaaagggtttatagtacagtttagaatgtatcccgtggaatccaaataccattgcaatataatgtctaccatcatatacttaaaaatacatgaaaaagctcatatttaataaatagaagttttatattattcctttttatttaaatcatatttttcaacttccccaatgaattgtattctaatgtgataaatatgtgatacatatttatgctataaagttttattagccactctatcataattctttataaaattatatttatgtggacttaaattcaatttttaaaaacaatttcctgtgactacaaggctctaagtatttttaaaattctctagattgagtagtatttaaagtattaataataaatacacttagtaataaccaaataacctaaatatatgtaccttttgataaataattattaaacatactcagtggatagttattgaaaatgaatctattatgagatggatgggtatttgatggtaccttgagtaaagaaggatttcagtcgctaatattttgaattgtacttttatttggcataaatgtatcttgactacaatgcaccagtgggataggtcagagaggtgtgcttttattttgtaaagcggaagaaagtctgtcattaaccaaaaagtgggcaagaaaattggaatgaagtgcctaccacaggaacaaatccagtcaaatcttttttttgtttgtttgtttgagacggagtcttgctcagtcgcccaggctggagtgcagtggcgtgatctcagctcactgcaagctccgcctcctgggttcacgccattctcctgcgtcatcctcccgagcagctgggactacaggcgcccgccaccacgcccggctaattttgtgtatttttagtagaggcggggtttcaccatgttagccaggatggtctcgatctcctgacctcatgatctgcccgcctcggcctcccagagtgctgggattacaggcgtgagccacctcacccggccgcaacatgctgttttaatgagcgcctgggtgcgggcagcctcaggcctaaaatggcgttagccccaagtgaggactggacaaaggttttatagtctcctgtaaacaggaagtctcctggcctgacgtaactgctgcattgtacccggatggcctctttctcgatcttcagaggtacttgtcttctggccggctctcttcctgcttctgctatttcgccggtgcatgctgctcaggcaagtagccttgtgccttaggaatgggcctgagaaaggaggagttactcatctccttaagctttcaggcccgggagagaatcttacaacccactgatgagttatgaaatccatttaatgggtaaaataaaatagaataagatagcatagggtaccaaagaatataacgcaggttattacattgtgttacgtgtggtatgcttaagtgttgttttctggaactgttgttatcatttgtattgtacttcatttttgtttcgaattttaagataatctgcacagttttatagaaaatgagttaattagtactgtatcagtgatgtcatactgggttaattattacaaagttgggggtaaatttatccctgtataacagactttaaagataatataaataggccaggcgcaatggctcacacctgtactcccagcactttgggaggctgaggcaggtggatcacgaggtcaggagttccagaccagcctggccaaggtgatgaaaccccgtctccactaaaaatacaaaaattagctgggcatggtggtgagtgcctctaatcccagctactcgggaggctgaggcaggagaatcccttgaacctggaggcggaggttgcagtgagccgagattgcaccactgcactctagcctgggtgacagagcaagactccatctttaataataataataataattttgtttatttattgaatagatactttcttccagtacaaaattcaaaagcattgaaatcctctgttgcattgttgtctttcagccacacagtttctctccccatgtgctgccaaggttttcagtttcctgggtagccttccaagaataggatgtaggtgtgtgtgtgtgtgtgtgtgtgtgtgtgtatattattttctactcttgtcctcttaaaataaagccagctgttagaatactataaatactgtttctgcatccttcaaaagatggttcttttgaagcccttttccttggcttggcgagggcagaaggaaaagcactcttcttcctccttcataagaaaggaaagactaaaatgcctgtgtgtgtgtgtgtgtgtgtgtgtgtgtgtgtgtatagcactcttctccctcccttataagaaagggaagagtaaaatgctgtgtgtgtgtgtgtatatatatacacacacacacacacacacacacacacaggtgattattttctgtattagtagttaaagaactgtctctttttttttttttttacagttgcatactattctgttctaaggatataccataattcacttaagcagcactccaattagtgagcctttagtttgtttcgacttttggctaagataagaaaatgtataactttgtgcacatcattttacacgttgcaaatatatctatgtgataaattcctagccgtcgaatggctgcgtcaaactggcatttgtcttgttagtacattttgccaaattgctcttcatagaacatctcgtcagtattaggaaaggtttcttttccccatacccgtgcccactcagtgtgttatcaacctttttgatcttctaaacaagaaaaatggtgatatctgtcattttaatttgaattctttattcattttgtgagtgaatttgaattttttcatgtgttgcagaatcatttttatttccttttctatgcactgtttgctacttttttgttttttgccaatgttctcttttgggttattggtctctttcttactaaggcaaatatagtttacaacttgaagtaaaaacatggttttctatgataaaggttttaatgaatgttttctacaacagacagattctagtcttaaggttataacctgaaaacatcaaaactaacctttgaattgcataggaatggtctttgctcttcttagccatcaatcctggacagaagttcaacatgatgacaaattgtagcacaagtagagatttaaaaaatttttaactaatatgtaaatatttgctttcattttcttatttatctaacaatacattgatggctagaacagggtttgtctttgcaaagagcctgtgtcaactgactcccattctttcaaaatacattacctaaagaaggtttgtggcttctctttgcattgcattttctagccaaatctgaaataactatctggaagcttaacattttattcccacacttatttttccttgtgaaaatcaaaactgcactttcccagtcttcatgagtaaccacaatggtttgccatttgacttgccagttgtattagcatactgagatgtaatttatctgcatcaagagagttaattctgagcagctgggggctttctaatctctttacccatcttggacaccagttccctctcactgctatttgttttattctttgcagttagaataccattcctcttgacatacaagaaacaaacccaatagaaattaaaaggttccaatttctattttccattcaccaatattataccattttctcctaaagcagttctactctctcctagatcattctcttgcttttgaaataaaccttaaaaagtcattttgtcaccctaaatatgtttatactttcttgaaataatgcttttactgcatattagaattttagtttttacttagcagtccttcactactcctttagaaggaaatttagataatactttgaaggaagttatgagagaacgtcagaagccatgctatcagttttttttttttatgtactctaaagaaaactctgctctgcccatgggtgtcatctctttctgattctgtgtggaggagaaaaatgggaacacttccaatcattttcaaacaatttctgcttaagtggatgaatggaccacctggtttactaactataatgcccaggggatggctttgattggcagacagaacgcggtgcagaaacaatggaagttaaatgaggaaggttttaaacttgcaagttacctcccttggtggcattgactgttggtagaaaataacacgttgggatttcagatacattcagacatgctctgcacttgcaatttgcaatacttaaaacaacacaattcttctaatcataactttttaaaaaatttggccacctttctccattgtctcataaagctatattcatgaagctgtttattcacaaagtcgtatcatttaaagataagtgttatatccataagtatgtaaatgaattaaaatctgggaggctaacacttatccattccttattctactatatcctatctagagccatgcttcttaaaatttaatgtgaaactgttatttctggtctgtggaaccacagtttgaaaagcactgtcatagattcttaagtagatacattttcatgcatacaataaatatgcaggagaagttaaatgggtatgtccgggagtcaaatattgattctcagaatgaaaacttcttcatttatttctcagtgatcttcataaccctttcccatactgggcagtgagaaaaaattatcatctcactctgaaatagtgatttcaccagtctctttttatgggttgggacctcatggataatgaccagtcttttagatttccttgctctcctcctgctcctctccaaaatggcagctgggttgacagatgaggaagcattatacatgacctgagatctctatgcaggtacttgcagtctcctctgaccctctgctctctggaacagtgcctcttgtctgcctgataagtctctaccctgctgaccttgtggctctgagcttgtattttcatcaggaaatacggttctctgctgactatatcagttactaaagggattcttaaatctctgagttactgctgaagaacacttagaattctaaatttgtaattatgatacctctaaaaacaagcgtgattatccattatgtataaggatgccttccaaaaagttggagcaacttgaagccacttgttacattgtcatttagtggaggagggagtgaacttggtgtttacaggtagaactctctatcaggtgctgtgaggaaaaacaaaagcaagataaactgtggccataatctttgttactttatttcccaatggggagaaaaagacaaatatatatatttgtcaaaactgaacagatgttatttgaacattatactgtatatgccattataactataatgtatataatacatatatataaattattgaacactaaaaagaacactttaagaattatctattttattttttttattatactttaagttttagcattaggagaagtatctattttaaataaagctatttcactcttcagtttccatctcaagaactcataccaatttaaacttccactcatatttgagagttgagaaaaattaccaaatgataataatatattatctaaaaaataatttaaagatgcatgtctctaacaaaactatgtaacattctgaagggttttaagtaatacttcatatatcctaattcagaataaacttagatgttatcagtatgaaaatatatcataaagtaacatgattctctccaatgaagatgtaatcatccaaactttatgcgttgaatttacggcttagaaatgccatagcaatatgtcctcttgaatatacaattctatatactgagatttcacttagtatattaagttctgtatcactgaagagtatattatgattctaattaacaaatacaattctattttatataagtacccctatcatctactaggcaaagttagctgatgttactatgcatttttttgtcagctgtactcaacttataataactttgtattccaaatacttcaaaattgccatatgcttactgttttcctattcacatcattttcccccctattcttcctgaccctcctttgagcaatagtgtcagtgggattagactcatgcattcacatactgaatgaatgaatcagtatgtgattcatgatatagaaaatttaaattccttatatatttcatatatcatatatatgatatatgtatctgtgcatataggggatattaaacacttctctgtatatatctgacatatattttgaaaaggaaacaccgtagggccaagttaactgcttcaattattacttagtgtaaatgcattcagtttgttctgtaatttcaaaatgatacatataaaaaagtagagtttgcatgtttaatacatctgaagctacagtttccaaattctgaacactttggtgacccccttgacacaatgaatatttggcagttaccgaacataacagggcacaaataatatagttaatgaaaacatccataattatttaaattaggctattttaagaaaagttttaatttgaacattaaacagcttaaaatcatttataataattgattatgtaacatgctggtcattaaaatgagattggtattctctttttttttttttttttttttttttttttccgaggtggagtcttgctccatcacccaggctggagtgcagtgctgcgatctcagctcactgcagcctccgcctcctgggttcaagggattctcctgcctcagactgccaagtagctaggattactggtgcccaccaccacacccggctaatttttgtatttttagtagagacagggtttcaccatgttgaccaggctggtctcaaactcctgacctcaagtgatccgtcagcctcagcatccgaaagtgctgggattacaggcgtgagccaccatgcctggccaagattggtattcttgacattaataattttggtaagcattaagaaggcaaaacatggaagcactcacaataatgtataggatccaagtaaaattctccttactgaaacatgaaactacaaagccatgtgcgcatacttttaatttttaagatttgtttgaaggaacttttgtgaatgacaagtagagaaagtgtggatagatagcatctctgtctttaaaattatttgatgaaataggtgataagaaacacaaaaattaataattcatgtgacctttattacaatacgtcttctggtattagcatagtaataagtattagtgatttacataattggagagataacacaaatacaaattatgcacacacacatacatacatacacgttcctgtgcttcactcaaaactgaacagatgttatttggacattgtactgtgtatgccattgtaactaaagtccaatttgttagagatagtattgttattttattatctttagtatcttcaatgagtccattatgaatagtagcattaactttgcttatgactagcttaaatagaactttggactccataaaaatacgaacaaagatttttaatggctttagaatacagaagtaatctggtaaaagtattcttgattttaatagaaaccaaacaatcaatgtgcccgttagattaacagtgaataatcagattgttccagctcttcactaatgaacaatgctgaaacaacattctctgtaggtctcctcagatagacatatgagaacacctagaagtggaattgttacctcattagagtattcacatttttaattttatcatatattgcaaattgcttttccaccagcagcaagaagtggcaggaatttattattttaatttgcatatccctggttgaacaagttttcaagtttgttggacagatttttccttctgtgagttgactcttcatatatttaccccaattttccgttggattgtttactttctcttaccgattaatatgagttgtctgtatattctagattctagtagagttctggattatatgcacctaatatataagtctacaattccttatccaaaatcttatcgttgacttttcaggagactagtgaaaatggctacttagtggaacatatggaaatcatgagttataagtgtataaaggctaagtgcaacagtctaaagacctggtatcacagatgaagactgacatattgagtaaaccaggaattggctttattacataatgtgtcctttttcttgatttcagaaacccatatatttgctgtttcctgtacatgtttaggaagagtattcagaagagagaatgcagatatattgttgctgtttttttttaaaaaaatacgagtttaattcaattacccatttgattgcttgagtttattagttatggtagcacttagaaagagttgttttagataatgactatgattttggtacagaacctaatagtaaaaacaaaacatctttaattttatttaaagtgcatgtcagtcatgaagtcagaattgaattgctcttttctttgcttttaatgaaaattagcctaatggctgttttatctttaaaaagcaacttctagtgtttaataataacagatttaagtaaatattctgttaagacttaaagaaccatgtccaattactatatggataataacttagagatgctctatattggtttaaaataatgcaaatatcactggccactattcagagatatgtcaaaatcacttttgtttaatatgtgcctttctagtccttagatctactgtattccctaatccttttggggtatataatccagagatattaggacccattcagccagaaactgaaacatgccatgatggttagaattcatcagaaccacactcaaatgaatgttaagagacatagcgtgataaaagtgcatctgaaagagtatatgaacagatgacattacatacaatgttgtatataagagaaaggaaggaaagacattcatatcatgtcatattaattcatgtacactgaaaatacagaccgtgaacagacattctttcatttgttccttcatgtattcaataatagaatgcttctctaccacagatgattccaggggaatttggcaattgctggagatatttgtggttgtcacacatgggggaggagaaagtgctactggcatcttgtgcatagtgaccaggcatgctgcaaaacaccctgcagtacacagggtagctcccgacaagaaataattatccagtcccaaatggcaatagggctgaagctgagaaaccctgattgaaactcacattacatcctaatcgaaactactttgttccgttctgagccgtaggattcatcaaataaaacctactttttattggtacaatatttaaatccagagaccctgtagcatagtaattatgtatgcaggatttgcctcagaaagactagggttcaaatctcagattcaccatatgttaggttgtgccctaggcaagtttctgacctttcgtgactctagttttttaatctgaaaaaatggtaatagtattgctgagaggctctgcaatggagattgagattaattaagatgatttatgttaagtgcatagcagagtgtttgcacttagtcagtttccaacaaatggtagcagtattacctttacatgtactaaatcatttcatcctgacctactatgaaaagcctgatcactttccatattttactgtttttaagataccattgattagagtatgcattgttattttatttttcaccaagaaaaatgtgctgccgttttagactatgacacgctatcatttataaaacgtgtcccaatttcagagcagctaacctgttgaaataaaatgtgagtcttataattgattattgtaaaacacaacagtaagtcttctttgattaggtgcaactgaacaatactatgaccacattcagtagcaaaggcacttagaaggatataggaatatagcttagcaggaaggtagcatcgggtatctctctttagtaggatgagtatgcgtagcaatctctgaagcacccagggagccatccaagagctattcactttgcagcacctgtccactctctcatgacatctcaggtgcacaggaaggaaacaaatcgagatgctgggtcaaccctggcctagaagccttatgcatcccagaggccaatgccttgtaacatagtttccaaggtcctcaaaaaggacatgcttagttacaagaattgttgtacttggggacgccccacaattatggttttccattaggtatttatagttcatatgtagaacacctaaccaaggtgtaatttaccagtccccatcatttttttttttaatctgaagcaatgttgcctgctcacacatttgacattccaactttatcagttttctagggagaagggagctagaaagttgatcaaagtacaaattctcatacagatggacaaagggtgtttttaaccctttactcacagtaatatctgttagtttcatttattttatatttaaagatactgaaacctgaaacttagagcagttaaatgacttgccccaactcatgggctaataagcctagaacccagatgttcttatttctagactgattatttccaacaacactgtaatatcctaaagcaagagtcagcaaactatggtccaagggccacatttagtcctccacctattttcagaaataaagagttattggaacacagccacatttatttgttcatgtattagacctgactactttcatgccacattggcagaatttgagtttggcccacaaagtctaaaatatttactatatggtgttttatagaaaatgtttgctaacctctgctctaaagtataattacaaattggccaggtgcagtggctcacacctgtaatcccagcactttgagaggccgaaatgggtggatcacttgaggccaggagttcgagacgagcctggccaacatggcaaaaccccgtctgtactaaaaacacaaaaattagccaggcttggtggtgcatgcctgtaatctcagctactctggaggctgaggcacaagaaccgcttgagctggggaggcagaggttgcagtgagccgagatcatgccactgcactccagcctgggcgacagagcgagactgtgtcaaaatagtaaataaataaacaaataaattctaattataaattgtttaactctttctatgagtctatataaggagtttatagaaaagcatttgtttctaatgtttgattattaaaaatacccctgtattttttattttattttaattgacaaataataagtacatatatttatgaggtacaatgtgatgttttgatatatgtttacattgtggaataattatgcatacttgaaggattttagagccacagagcctgaacctaaccgtttctctacatcagtgttggccaacttttttctttaaaaggccaaatagaaaaatttcagtcagtttttgaggcttcatgggccatttggtctctgttggaaatagtcaattcatgctaggattggaacctagataaccagactcaagagcccatactcttcaccagtaaggacttaggaaggcagcaagacctgggagtaccagtttaaatgaatgttcttctaagcagtgtcctgtgctgctattaaaccagaccagagctttggcccttagttaagaactgtatgtataaagttttccaaaataatggcttcaggttttcacaaagtccttccatccaaacaatgcagattgtacccccttaagaatctgttcttaactgccatctgttctctgcattcttaaagtctaatcttaatacagcagccagaatgatctgtttaaaaataagtcagatcacatcactcctctgctgaaaactctcctatgcttcctaatctcactcaggataacagccaagatccttccaaagatgcaggacctatcctcctccatccccaactctatgactatcattcctactactctccccttgctcactagattccactcaccctggtgtccttttttttttaattgaacatacacatacactcctgccccagggcctttgcacttgctgtctctgcacagattgttctttcctgagatagctacttgaatcgttccctcacttccttcagatctttatttaaataccacctactcagtgaggctttccctgcaggcactttctaaactctccacatgccacctccctttgccccatacctaagtctcttattcctatccagtgctttacattttgttctttagcacttttcactctccaaagcaccttaatttctcttttactacacattatcaccattagaatgtaagttttatgaggacacaaaaagtttgtctgttttattcgctgttacatatctagtacctcaaacaatgtttagcagacaataagtaatctgtcaatatttatggaatgactcaagtgattttttggaagagttttggtaatatttcatttgccaaaagaattctgccaaaaagactttgaaacccccactttaaggtggagagcttccatagaggcttctggatgttacttgatggtcacacctatgcccactctttcactggccttgaacatttcaagtatgcagcttagtagattatatcttcacagtttcacaacactttccagtttaaaaatcaatgctgcattatgctttgtatatttggacagattatttttgaaatccataaatctctaagttttttttttttaagtctccctttggtgagctgcccttgattagttcaaaatgggaagagagaacctgtcattctttgtcaatcaggttggcacgtacttgacagcatgcagttatagtgaaagagagctgtgttgcagtggtctagcaaacctaattgtagttaagtaaaagaacagtcacccaacatgagaggaaagacaaagaaactcaactgaacaatgttgtgtttttccatccatcagccttcatttgtcagagtctgactgacaatctggactgcagaaatcaggctctaacacaatattgattccatttcatattttgtttcttgctacactttttagcaaacagtttctgtatggaatgagagatagtgcagtcaatatatgcgaccagggcacatttatattaaaggcttactttggtttttttgtcccagaaatcacatattgtttgtttgttttactataatattgtaattgtcagctcttgctgcagtaacaaacaatgacaaaattccagtgacatataacaacaaacatttattactcactcatgtgtctgcagatcagctgcagctttactccacactatgaatcaagttaaggtcttttcattctagaatatggatctgctctaaatgtcttctcatcccaggaccctagcggaaagagcagcttttatatggcatattattctctcatgatggaagataagaacaaggggaaccagcaaatcttgaactgcctttaaagttccagctaagagctgccacacagtcccttctgtctgtccatggtctattggtcaaaggtacacagtcaagcccaaagtcaatgggaagggaagtatattcactgcagggcagccatattaagagaggaaatgaataataatgaactgacaaatcaaccatagtatccacaaatgtcttaggatttcattgattcccaaatgcattttttagtatttcaacacctctgaacttgagatatatcgtacaatagataatgtttacaaagtgtaggtttttttgttttttggctttcttagtttacataacaatagtggcccttatcatcaatgatagattagatagaaaaactgttaattgtggggttgacaaaatagccaaatggtagaaggcactccttataagtaagtaagttatgagtgggagctaagtgatgagaacacatggacacatacaggggaacaacacacaatggggcctatcagagggtggaggttgggcggagggagagaaccagaaaaaataactaatgggtactaggcttaatatctgggtgacaacataatctgtacaacaggccctcatgacacaagtttacctatgtaacaaacttgcacgtgtacttaaaataaaagttaaaaaaaattaagtgaatggacacttaatgtttacaaaaaagttgtcatttttatcttgaatttcttttttctgtagcaatatttatatctcattcagatcagcttatttgattagaaaaccaagcattaatagtagatcttatgtctatttattcacatattcatataccttcatttataaatatatattcatatatatttagaagatcaattggaaaacataagtgccattcccttatttaaaactcttgtagcttctccactacagttctgagggtggtatacaagatccttcttttctctggcttttgctttctatttctactccattacttcccattcccctacgtgatagctccgtacttcttctgcttcctgtctttgcatgttccatgttccctcttggaatacattctctctgccgtccatccccttataatgaggtgcatgagctgtttctgctcccagcctttctgtcctgaccttcttgtctatcaaacacaaaagtgatcagttcctgctctgtgctccattatacattgcactttactagttgttatacctgacctgctctaaatgtagtatatatttgtgtgtctgcactccccattcctaccccagtgaaacatagtaagcactgaataaatgtttgtcgaatgagcaaataaataaataaataaataaataaatgtttgaacatacatggaaaggttgtttatgtcctccttataatgtgctttgagatatatattcttaatatatatataatcatatattctaaggttattagtaggtaaaatgaaaatttaaagaaattgagtacaagaaaggaaaacaaggaagaattttttcctttttgtactatttctaagaacaccaaatttctagttaaacacacgcacacacaatcggcatgatgtagaattagaaatatgttgaataaatcaattattagaaaatgtaaatatatattaatttgcctctgacttgctacttttaccctcaagggttttttttttctacctcttttcatcactaatctttgcttcactgcttgtcagatcagcaactgcccattattagtaatgccatttaataagagataaataaaagtaaaggtgcttagagttactccatttcaaaaacctatcagggctggatttcagaagagaccatgaaattctcctactgttattgaaccattactccctattacctaattaatacaagttattttcttaaaattatacctgacattgtagtgaactatcaatactatgaagaaaatcaaactctcctcgtatcataaggatcttaacacctggtacacaatcttgcattggaggggacattaagaataaggcatggaggaaaaaaaaaccttaatggaaatgttctgttattagaaatgagactttttggtggaaatcccatgacgactttcttgtctgaatgttctttgaagttgaacactttctccttacacaagccggccactataattagctatgtttccattttagtggtggccttcttcaccttatctgaaatcatataaagatgtgaggccatttgcgagataaaaggtttgctcaaaccagttctctgacctggatatcagaggtttggcaatcataaacccactaagagaaaccctcagagctattacaaggctatgtaaaactttatttcattttttgtgagaagggacaggattttctctcatttatattctggaagaatattgtagaatgtatttgagttcaagaggaggagaaataattaacataatattaagaaacgtcaattttggaaagaaataataagcatatatgcacatgtgcgtgtatgcacacacacacacagtatacacaacagattcagaaagaaggaaatagagatttggtgacacatacttcctggatataatctcaactctgccatttgcaagccacatggtcttggataattgacctaatctctctcaattgcagcatctgtgaaattagataaaactttctttgtaggagtgtatgtgtgtatgaaaagcacagtgtttgacatataataaatgttttagcaactgtagcttgttaatattatcacagcagttaatatcactatagcagttagttgccattttcagcacagctaataattttagtagcattttctgatctttccatctcatgtggtttctttggagttgtttcttgctttgttttttagcttttctatgtcacattttatttgcatggagaaataacaaattttacaatttatttcacatattctttaatttttaggataattgtcagtttcttacagtttattttccttatactcactgaagaaaatatgtacgaaagaatattttcagtgaagttaattggatttactacagttgacccttcaagcaatagtatcttgcccttaataactgacctatctttgaactaataaattcaacctgcaaataaatgtagtgaggtaaattgtagaaatttatcttcaaaatggtctttctaaagtgatctatcaaaggtgcatttaattagaggtccagttctccaaaaatgtgccaaggaaaagtagccacaaagaatttagagctgaaatgaattctttcacccattgctctgtttctatagaactgagaataaatctcatatgggtacttaaaatctgtactatgtcattgaaggatgaaaagatgacaatagtgatgatagaaggacacggtaataggaaacatttcaatagagggaaatgatgtgagtatgcaatgttcattcaccagaggactaaatctagggctattttggtgacttgaacagggaatattctacttcctgcaagtgaaaaatatggacatttcatttggcatgccacctgctcttcagtccatcatgtagcaagcacccacttagtactttggagctctaagtaatacttggactactcaaatgccagccttgttgccatttctgtttattcgccaataacaattttattaattaaaatttgtatgtggatgtcttaaggaaattccttgtagttgtcaaagcagactcctgatcctatctatctgccagtgccttctgagtagtggtatctattcttcatgatttttggaactatttatgggtgattgaagaatatggagtggatagagaaggatgctagtcatttggctgcacacaagaaacacagatgaaatttttgactatttctgttcattttctaaaggtacagaattttcactggattgtacttgtaagcaattttaaaggaagaaatatccagccttttgaatttgttacagtgttgcaagacttttttaaaatgttaagaatttttatcatataggatgaattaatactctcataattttaggtttgtttcttccataattaataactatccttaaagattgtgtgtgtgtgtgtgtgtgtgtgtgtgtgtgtgtgtatttcttgattttccagagcaaacgttcccattcatttgttttactcaccttgttatagttgctcccattgtaagatatatctagtaagtttactgttgttacctaaatctgtttgctgaattttaaaaatgggaacatgtagtaaatttgggggaccacgagctagtatttacaaagtaaaccgagaacattggatataaaaccttatttcatttaacctccaatgaaggatatattcagtattattatttgtattatttcttgagcttccttgcttatctgtaatatgtaacatggtggcaccccttttcatataattctctcctcacttctattttgggtttttacatgttcttgtttcagtctcttctgctctttctatcttttcttggttcaactttcttctcttatcctgtggaggcgaatacctaattctggctctatcctcttcagtcactctacaagtatcactgggacaatattgtccaactactatttttacctccaaacctgtattcttagccttacccctaatctgcacactacgcttctttttgcaattactttctgtacatttgcatcagtgttaatcacaggcatcttgactcatgtctccaacctgaaaacattattccttccatatagggacaggctcctctgtcttccctgtacccctagacagtttctcccaagttataaaatcttggtgattctgaaaattttctttttccccatcaagtcctgccagtcctttatccacaacataggaataatacttcctgaacatccgtgctgctcctgtttgttcaataagtactcggacctctaaaggcatttcctatgtttcttccaccagccccttatccttaaaatcttgcctccaatctgccgctagagttatcatcttaaaagagtcaaatcagggttggtatccaagaaatattacaaagtactaagctcttggtatatacaatcaacttgagagaaagagagggacgggaggagagggagagagagagagagagagagagagagagagagagagagagagagagagactttattctgtcctctataacacctgaatgattctgtacatatttatgttaacagagcattgtactacttcaaatccttatacaagcaaaactcctcaccgccttttggcaatggaacttgcttttccctctgcctgaaatagtcttcagtatgttgacatgactcatttcttcacttcattccatttcctgaagagaggagcagtcttctgtgctcacattgcctaaaatagagcccactgtcactctctacttactctttttaatctttcttcatagcatacatatacatatatatacacacatatacatatatatacacacatatacatatatatatatatatgtatacacatatacaggcatacctctgagacactgaaggttcagttccagaccaccataataaagtgagtcacatgaactttttggtttcctggtacatatagaagtcaggtgtacactacactgtaatctattaagtatacaatagtgtatgcctaaaaactaatgtacatgccttaatttaaaaatatgttattgcagtgttcaagctgagagccaaatcaagaatgcaaactatttacaataaccacaaaaaataaaatatctaggaatacatctaaccaaagaagtgaaagatctctacagggctaactacaaaacactgctgaaagaaaccatagataacacaaacaaatggagaaacattccatgttaatggaaaggaagaatcaatatcattaaaatggacatactgcttaaagcaatctacagattcaatgctattcctatcaaactagcaatgtcatttttcacagaattataaaaaactatcctaaaattcatatgaatctaaaaaacagtctgaagagtaaaaacaatgctaagtgaaaagaataaagcatgatattaaccaacttcaaactatactataaggctacagttacccaaagagaatgggacttctacaaaaacagaaacttggaccagtagaacagaatagagaactcagaaataaagccgcatacctacagccatctgatctttaacaaagtaaacaaaaaaaaaaaaaatggggaaaggactccctactcaataaacggtgctgggatagctggctaaccgtatccagaggaatgaaactggactcctacctttcactatatacaaaaattaactcaagatggattaaagatttaaaaaaataaaatctcagccaggtgcggtggctcacgcctgtaatcccagcactttgggaggctgaagcaggtggatcacgaggtcaggagattgacaccatcctggccaacatggtgaaaccccgtctctactaaaaatacaaaaaaattagctgggcatgctggcgcatccctgtaatcccagctacttgggaggctgaggcaggagaaccgcttgagccagggagtcggaggttgcagtgagcccagattgcactgcgccactgcacttcagcctgacaacagagcgagactccgtccctaaataaatacaatacaatacaataaaatctcaaactagaagaatcgcagaagaaaacctaggaaatactattctggacatcagccttcagaaagaattcatgactaagtccttaaaagcaaatgtaacaaaaccaaaaattaacaagtgggatctaattaaactaaagagcttctacacagcaaaagaaactatcaacagagtaaacagacaacccacaagatgagagaaaatatacacaaactatccatcagacaaagatctaatatccataatctatagggaacttaacaagcaaaacgcagataaccccatgtaaaaagtgggcaaaagacatgaatatatagatacttctcaaaagaagacaaacgggtggctaacagatatgaaaaaatgctccacatcactcatcattagagaaatgcaaatcaaaaccacaatgagataccatctcacaccagtcagaatgcctattatcaaaaactcaaaacacaatagatgttggtgaggctgcagagaaaagggaacattatacgctgttggtgggagtgtacattagttcacccactgtggaaagcagtttggggatttctcaacttaaaatgcactgtcattcaacccagcaatcccattactgagtatatatccaaaagtaaataaatcattctaccaaaaagacacatgcacttgtatgttcactgcagcactattcacaatagaaaagccaaggaatcaacctagatgaccatcaatggtggactggatgaagaaaatgtggtacacatacaatatgaaatactacacaaccattaaaaagaatgaaattatgtcctttgtagcaacatgcatgcaactggaggccattatcgtaaatgaattagtaggaacagaaaaccaaataccactttgttctcacttataagtgggcctaaacattgggcactcatggacataaagatggcaacagtacatactggaaactagtaggggaagagataaggaaggggcaagagttgaaaaactaactattagatacggtgcgcactatctcagtgacaggatccatcatactccaaacctcagtatcacccaataaatatataaatgtaacaaacctgcacatgtaccccttaaatctaaaacaatagttgaaattatttaaaaaaatactttgttgctaaagcttgctagcagtcatctgagccttcaatgagtcttaatctttttgctgatggagggtcttgccttgacggagatagctgctgaccgatcagagtagtaactgttgaaaggttggagtgactatgccaatttcttagaataaaacaaccatgaggtttgctatgttggttgatttttttcacaaaagatttttatgtagtgtgtgatgttatttgataacattttacccacagtagatctttcaaaaatgaggtcaaggctctcataccctgctgctgctttaccaactaagtttacagaatattctaaaccctttgttgtcatttcaacattgtttacagcgtcttcaccaggagtagattctgtctcatgaaaacactttgttttgctcatctataagtagcaactcttcatccattgaagtttcattatgagatgacggccattcagttacaccttcaggctccactttattctagttctcttgcaattttctccacatccagtgacttcccctactaaagtcttggaccctcataggcattcatgagggttggaataaacttcttccaaacaccttgtaatgttgatatttacctctttctatgaatcacaaattttcttaatggcatctggaatggtgagtcctttccagaagattttcagtttacccagatccatcagaggaatcgctacctagggcagctatagccttacaaaatgtactttttaaagaataagacttgagagctgaaatgactcctttgtccaaggactgcagaatggatgttgtgttagcaggcataaaaacaaaatctcttggtacatcttcatcagacctcttggctgaccaggtgcattatcaacaagcagtaatatattgaaagagattttttcttctgtgcaataggtatggccagtgggcctaaaatattcagtaagtaaaccatgctgtaaagagatgtgctatcatccaggctttgttgttccctttatagagcataggcagagtctattagcataatcttaagggccctaggatttttggaatagtaaatgagcattgtcttcaattgaaagtcatcaattgcattagcccctcaaaagagagtcagcctgtcctttgaactttcgaagccaggcattgacttctctctagctatgaaagtcctagatggcatctttttccaatagaagactgcttcatctacactgaaaatctgttgtttagtgtagctaccttcatcatcttagatattagcttgatcttctggatagtttgctgcagcttctccatcagcacttgttgctccacctttcacttttatgttacggagagggcttcgtcctaaagcctcatgaacaaacctctgctggcttccaacttttcttctacaatttcctcacctctctcagcattcatacaactgaacagaattgggccttgctctggattaggctttggcttaggagaatgttgtggctgttttgatcttctgtccagaccactaagacattctccatattaacaataaggctgttctgctttgttatcatttgcatgttcactagactggcacttttaattttcttcaagaatttttcctttgcattcacaacttagctaacgggcacaagaggcctagcttccagcctctcttggctttcgacatgccttcctaaccaagcttaatcatttctagcttttgatttaaagtgagagacatgcaactcttgttttcccttgaacatttagaggccatagtacggttattaactggcataatttcaatattgttgtgtctcagaatagggaggcccaaggagaggaagagaggtagggggatgactggtcagtggagcgttcagaatacatacattaatggattaagtttgccatcctatatgggcactgtttgtggcaccctgaaactattaaaatagtaacatcaaagattactgattacccatcaccataacagttataaaaatattgaaaaagcttgaaatattgtgagaattatcaaattgtgacacagagacatgaagtaagcacatggtgttggaaatgttgctgatagacttgcttgatgcagggttgctacaaaccttcagtttgtaaaaaaaaaaaaaaaaaaaaagcagtatctgcagagccaataaggcaaaactcagtaaaatgaggtatacctgtacatatacatacatgtgtctatatatccactcacacatatgtgtatgtgtattatatgtgcatattatacatatatgttgatatgtgtatttatcatatctaatacacatatatgtatatacatgtatatcacacacatatattcatattgtaaattgaaaattttctagtgctgtatcccaatctctagcttataaatatattgaatagatgatgcagcaggtatcttttgaatacgcactccaattttagaaatataaatcttttttaaaggttggaataatataagtagtttggtgttcagtgcaaaaggttttaatgtataaatactatgaaaacaaaagttagatcaaatgtatcaaatacaaatgatctgtattgggggacagagggacacattaaatttaagggaatatgaggagaatattgacttcctatgctcgatgagtgaaaaagaaaagtgaagtgggagtgtttgaaaggaaagatgagcttttccatgctagtacatcacaggttttaatactcatagaagtttttagatttgtataggaaatatgatcctccagcctttccaagtttactcttctactggaattacaaatcaaaactaataaatgtttactatgcttcaagtgcaatagttataaagtacctgattagaggtcccacattcagatgttggttatataaaatattcatgctaaatcatataaatgctaaaacatttgtatttgtgatgttctcttggattgctagatggagattaaattatacaaattcagctaagaagaaaaatgtgggataaatggaattttagtttaaaggaagtcaatgaaaggattaattaagtataaaataatcccattttaatttgtcatagaaatgagttttctgagacattgttgtaatcaataacgtgaagatgtaaaattttgcaaaaaaaatcattacgggaaatccaaaagcagaagagtagactctgtatttaactctagcagattatttagaaagaaaatagtctatgccatgaacctttcgactgtctgcgtgaacaaatgtctctagtaatacacactcttaactcaattcccataggctcaaagttgcaacagtatttatttgcccgttcaacggttttttgtttagcacttactatgtgttaggcacttccagggatatgagtgaacaaggtagttatgggtcttactctcatagaggataattctttaggaatggtcaaaactatacatatacacataatgtgattaattgtgatgtgttttgaaggaggaagcaaaggagttggaacagtttaaataagactgtaggttggcagtgggaacaatggtctttgctatcatttttcaaaaattccaatgaatgggaatgacgactgttgcattaagttgcctgtctccctctgacccatagtgattctctattatcagagaggtagggcatgtttttcagcatatgtgataatatcaaacagattcagatggtgaaagtaaaatttcttaatgcttagaaataacataatttgatcaaatcatttggatatgttattaagttgttgtaagatatgaagacgtagctgttactactgccaatagtataaactttggattcagacctagctgtgtttgaatattaactctcccacatcccacgaggttgtgggcaagctattcacatcattgtcactaccgtcactactatcccacccacccttgcttcattttcttatctgtaaagtggcaatctgttggaatcagggttggggaaggcaaatagtagtcattatacgaatggtaactatgctatcatcaataatatagtctacagctatgatgaagctaatcagaaaacattgtctattaccagtaattagctatatcaataactatcacaagaaaagtcccagctgtcagtgaataaatagaaaatagtgctttgtcttagagaaacacatacaaaatgaatggtggtgacagtgctttaagttaacttgtcagtttatatgtgtaatgcatatataatttcaaatgtataatttagacattgtacatgtatatttggcctggtaatttatggtatacataaatgataaatgtataggttgaaaattcagttactttttttccttttcttaaatcatttttaccttgctgaagatatgctcttttctctacttccttagaataatatattttattttctcttaaagtattttgagaccatatcaccatttactacaccaaaatgtttttttgcaaatgcggtattcaagggtgaatttatagtggctggggacctatttggaattcagtaagtaaaactagattttccttattcctcatctgagatcagagctatttctacctctagcaaagacatacagtcattccgggtgctgcattttcagggaacaatgtgttttcttggcaaggggcagtaagaccatcaattaatagttcttcatgtaaagtagctaaactactgttataaaggaagtgaaatttgcatacataaccattaacacatgaggttagttatgtacaattttgaccaaagtgcctgtttgctgctggtatttattataataagaactggaaaaaaatagtctatctcaagagcatgtgctgagcacccgtaaattgcaagagactgtactgggcagtatgagattatagtaatttgggatttcctactaatgaactgagagggaacaggtacaaacacagtatacgaaggaaacagtggcacggagacacttaaacacagcagtgctgggaggctccggggtaggggagggaggaagagagatacgggttaatcaggagctgctctctggggaagattgcccaggccctgactgatgcctgacattgattaattgatactctatcctagtgtttaacaagtgttccatccaaaaagtcttctgtaatatttaacttcacttccttcagcttcaatttctgcacaattcttttgtcgtctcatcaagagagctagtcagcagacagtaacaaaatgcttatattcatatacctgaaggatttttttttgtcatgcttcagccttctccagactgaagaaaagcaaataataaacaaaattaatcgttcttcagaaggcctgtttgactcattaataaataataagctttgatactgtgctttaagtgtttaccctttggaaagaaaataattttgacagtgatgtagaaataattatttgatatttatttcaaaacaaaatttatatccaatactaaacacagaattttgtaaaacaataagtgtataaagtaaaatgaacattaggattattgagattattgtagctaaaactagtgtttattcatataaattatgttaataaattgtattgtcattattgcattttacttttttgaaaagtagttaatgcctgtgtttctatatgagtattatataattcaagaagatattggatgaattttttttaagtttaatgtgtttcacatctctgtttcttttctctgcaccaaaagctacatttttgtgcccttatgtaccaggcagaaattgatctgcaatacatgtggagtctccaagggtatatttaaatttagtaattttattgctaactgtgaagttaatctgcactatatgggttcttttccccaggaaactgaaatagcagttcaagctaaacaaccggatgtggaagagattttgtctaaagggcagcatttgtacaaggaaaaaccagccactcagccagtgaaggtaatgaagcaacctctagcaatatccattacctcataatgggttatgcttcccctgttgtacatttgccattgacgtggactatttataatcagtgaaataacttgtaaggaaatactggccatactgtaatagcagaggcaaagctgtctttttgatcagcatatcctatttatatattgtgatcttaaggctattaacgagtcattgctttaaaggactcatttctgtcctggtgtgctgccatcaatacaaaagtagtcccaccttcaaggtagattaaattctttggggctttattgctttgcttgccagccttgatgcttttcatattgtttggtttaattcaaatcaagctactgcatcatagtgtctgtctccaacagctgtaaagaatcacaatatggtccgtgacctttcttttctttgttgctctttcttataaaagagtaaaatcggcattgaggcttcagtattttattgggtcaagaatttttagtgaaatgtcatgtaattgcttatttctttggcaaaaagctggcctgggataaacctttctacttttttttcttctccatatccatgttgaagtctaggtcacatttattcacaggctattacataaggagggagatggaaagccaggtcagttttcaaaaaatagctaatcaatggcttccatttgcaaatgagagtccagtgctaaatatacgttagcagtaggttacctgattctctgtacctgaccagaattataatggctcccattatgatgaaggttcctgagatcctgtaatcatggctgtttattgatcagtcttggtttctcagttaatgttgcaggcttggatacaatgaacctcgtcctcatgtttaaaactgcttgaaaacagttcaggtcaataacctcattatacagaaccagtttgtccttgcaaacaacattaccatgacttagattctgtctctaaggtcgctgcttagtttcccttgcgcttggcccaagcttcatttctagaagattgtttgttttccttacagcttacaagagacttttccttaggtagagttgaagtttgcacctgagcttaatgtccaaacaccagacactgaaaatcacaggtttctctgtagatatcaacatacttttattcagaaatatattgcaaccactccaaaaatctagaaaagtagtttgtatccagttcaagcccagtataatcatttttcataagctaacaatgtgctcagtatttagttggaagagctaggcaaagtcctgaaagcagcaaatttcagagtttccgttgatgttctgaagaaagccagccctcagagcagttaatatggtgactttcattgtagcaagccatgcagtgcacaaatggacaattgcatacgtttctatctactctttgttgatcctcaaagactttatgccttatggtgtatgactatgaattaaggtttgtcactaattgttagagatcacaaaggtacatgtaatttggcttttacttttgtgcctttgtaaaagagagagagagagatcttaattaaaagccactgagaaaatttttgctttcattatgtataaaacaatccaaatgcttgatgctaacttatcgcacctccacccacacactcaactactgggccacttggagatcagaactgggatctgccatgcctgagcatatctgcttcctgctgatgcattagtgatgtaaaaggagaattacttttctgaaataaaaagaaagaaccaggagctgttgctttccttctctttcacaacccttaaaaccatttttgtagcagacagcactgtttttttccttcctttttttttttctccttccctgtttccctattttctctcaatttgacacattgggagaagctgaacttaagggaaaatttattcctgtcttcccatttctcccttggatttggagaaaaatcaacatatcaagttggctgggcatggtggctcatgcctataatcccagcactttgcgaggccgaggcaggcggatcacctgaggtcaggagttcgagacctgcctggccaacatggtgaaaccctgtctctactaaaaatatgaaaatgagccagctgtggtggcaggcgcctgtaatcccagctacttgggaggctgaggcaggagaatcacttgaacccgagaggcagaagttgcagtgagccgagatcgcgctgttgcactccagcctgggcgacacgagcgaaactccgtctcaaaatatatatatatcaagttgataggggcaaaaatgcaagaatgatttgagaattatggggtttaaaaaaatagttgactcacgcacaacttttgctgtggaccatgaccttggaaacatctgaagattagctggggtttgcggtagcctgaaacacctagaggctcaaaaaatgacctcacagttttgaacatgacacccagcaatacaaggcagaaagctgtgagggctgtttaaatctctgcatggatcaaaaatttatttttaaaggttagagatgatttttctgaaggacactccattgctctgatagaacgtgaacaaagcctttttaaactttgagtccatatatcaaaatttaaaatttgtcctatttataatgcctcttcttcactctgggtcttgttacctcttaatagaagaggaaatgagtctgagtagcctgcagcacattttcatgagagaattgtgtttctgtttttgttttttgggggaggtgcatttggaaactgtaataattatgaagaaaatgatattctttaaaaagaaaatgaaaatctctcacgatgtatatgcaagatctagtatttaaatgcataattagtgtgtccaccgcttacaaacattctaattaaagacacatcagggagcaattctgtttcttaggaaattgacttgtctattggcacctccgcattctgcatcagacagcctgtctgtccagctcctacgctcacctcccaagctgagttctgattggaagctgggttcatccctgctcagtttctttcctctttcttctttccttcacttcgtcaacttctttaagatttcttttattttcaaagatggtatatttctggtttcttttttaaaatctctgactaaccaacttctttattttctttgaggacttcctgtaaaaggtcaaatacatattatgaaatgataatactaatgacgtataggtagtactaatctctgctgcaaaataactggaaaaatcttaggatcgtatgatcaaatacctctccatctttgtttagcacttcaactctctttctctctctctgtctctctctctctctctctctctttccctccctccctctccactctctccctctctccctctctccctctctccctctctccctctctccctctctctctctctctctcccccttcctcccccatctacacacatacttttatttatttgtatgttatttcttcatcttaacttcagaaattactgaagactgactatatgagttatataaattgtttaaaattttgctaaagttatagttttggtataatatattacattaatgccatagatgaaatagtctttaatgtgttccatttttccacacagtaataactaggtcctcaatagcaccccatttagcagtttaaaagcagcaaaaacaactgctatcagtaacaacaatataaactacaaaagaagccatttgttatttgatttttattataaaattgtatttttaactgtcttgagcttaagcatttaggtgccattttcttgtattcatactcatttttaacttaagttggaaaactacactttcagttaacttttaaaaatatgtttatgtactttcaatgcttacatcacctgccatgtattagaactgagagcattaatggaattttaaatgtcttggttactttctaaagtgataaaatgaagccagctggtttgctttgctaactttttatattatcaaaaaatgttacttacacaaacctagtaatatgttttacttactgctcttgaattatttttcaatgtaacagaaaaaggtgtgaggaactttctgtatttggccaaagcgttccatcccaacctttaacacaaaataattgctgtagacaaatggtcaagagggcaattataatcttccaggcatcatttcctcagatatgaactgcaaaatgacagcatcattagtcattttcaattacagtcagtcacaaccagggatgattcattttcccagctgttttgttgttaattaactagatgaagctgtttttttttctcccaatgagtttgttctactgccaacatcaacatcttaacatttttaaaaacttccttagggtttattttttgcctaacaatctttaatatattactcacaaaagatgtgcatctcaagatttatccacggtatagcaggtcaaatggtatttcattggtcgaaatgttgccgaaataaatataattacacttaaaacaatacttggatttcataaatcatctgccatgcgtacaatctcatttacctggtgtaacttcacttgtagcaacagaaatcaatagagagataacagacaaaaattgtcccctgaaatgaacaagtctattttgactgactcatttattgagcacaatttccatgccaataacaccagaataagttgggagaggacttctagaaagaagataacaatattagaggcatttaataatttataagtaaatgcatagcaacattttatttttttaaattacaagtttgcgactgggcgcggtggctcgcgcctgtaataccagcactttgggaggccaaggtgggcggatcacaaagtcaggagatcgagaccatcctggctaacatggtgaaaccccatctctactaaaaatacaaaaacaaaattagccgggcttggtggcaggcatctgtagtcccagctactcgggaggctgaggcaggagaatggcatgaacccgggaggcagagcttgcagtgagctgagatcacgccactgcactccagcctgggtgacagagtgagactccatctcataaataaataaataaatacaagtttgctttacaactgaaaaaaaagtcttggagtataagaggttgaataaatgctaatcccaatgcataaacttgaggagagcttcactttcccaatgagaagagaaaaaatttataatagatttttgggcaacttgtaaacataaacatttagaaatatggatgagattgtcaaatgtctaattatattcaatttcttaattgagtagcatttccatatttgcagtcttacattttataaaataacacactcatttagaaatacctggcacatttatattttatgaaacaatttcattcaaacccttcgtatgtatattctagaattgtagagctcatcaccttgctaagttatttgtaatatggcattgtttgaatccctacataatactctgaaagccctctggccaagattacaagcaacatatctgtaatcaaaaaattaagaatatttaccttattgcagcaagagcgtaaaacacttcagagtgtgggcatctcagtaagagggcattggaaaaagcttcttacagagttcagctggctgcatgattctaaggaggaattcagaaagtagaagccatttctggattagatgctttcaagaaacagagtcaatgtagtgattaggtatcttagtgtttatctagaagatgagattaaagtagggctagacacgtcgttggtaaaggagcagcaatgcctcatattagtcatttctgtgatagcagaaaggccttgtctctgtcttgtttcaaacacggccatggggtggccttgtgtctgcctagtttatttctatgagtgttttttaacatccagctgggaccatcatggcctagctagctgccagctgccagctatcagcagagctatttttcacgttctcaatgctgtcgctgaaatttttatcccaaacttcaatacccattcacaaaatattaggaaaactgtttttttcatttttcttagatatgattttggttgtttgtttgtttttgagacggagtttcgctcttgttgcccaggctggagtgcggtggcgcgatctcggctcaccgcaacctacacctcccaggttcaagcgattctcctgcctcagccttccaagtagctgggattacaggcgcccaccaccatgcccagctaattttgtatttttagtagagatggggtttctccacgttggtcaagctggtctcgaactcccgacctcaggtgatcaggctgcctcggcctcccaaagtcctgggattacaggcgtgagccactgcacccagccagatgtgatcttttaaaaattcccaatagactaacatattctttctgctttttaagttgtttggctttttaacaaattctttgaaagactcgtttacaatgatctctgccacgagtgattgtgaagctatacattaggaatgattgctaaagatttatcaactttctttgcctccctttttaattaagcaaattctgtcagaatacttatgtaagcatcacatctcttgaggttatttcaggctaatatacaacattgtggttccgaataaaataattgagacataagagatagtataaagtcttgaatatgagccaactttcttttctgagagaatatttgagtgaaaagtctcatgtactcagtagctcatgctgaaattagggaagcattttagagatttgaatttcacctcttgtcctcagttgtattagttacacttaaagagagagacaaagagacatagatgtttcagttacaatattcgaatgtatgcctgtatatatacagccgtaggtagagtcctttatttattcagtagatattaattgcatgccaaccattgacacaagatatatttttaaattttgaaaatctcaaactcaaatagagtttaaaactatattctagtttacttttttaaacaaatgattttttatgattgtattaaacaaatacattatttttccttacttattctacatcaaataatatctatttctagaaggcttttttccttgtcttaatgatagaaaacataaaaatcatttaatattttttaaatatccaaaaaatatgaggcaagaaagcagccacaattgtagctaccttaggaaacttaattaaaaaatttttttttatttttaattttatatgtgtataattgtacatatttatttgtgcggtacaagttatattttgcttattttttataatttcagtagttttgggggtataggtggtttttggttacatggatgagttctatagtggcgaattctgaaattttttatgtatccatttcctgagtactatatactgtacccaataaatagtcttttatcccttacctcactcccaagctccccacttagagtccccaaagtccattgtatcactccgtatgtctttgtatcctcatagcttagctcccacttacgagtgagaacatatggtatttagttttccgttcctgagttactttacttggaatagtggctgccagctccattcaagttgctgcaaaagagattcttttttatggctgagtaatattccatggtatatagataccacattttctttatccattcattggtcgatggacacttgggttggttccatatcttgcaattgcaaattgtgctgctatttttgtgctgctgctttcttttttgttatttccttttctggttttggtattagggtgatactgacttcatagaatgatttagggaggattccctctttatcttttgaaatagtttcattataattggtaccaattcttctttgaatgtctggtagaattcagctgtgaatccatctggtcctggacttttttttggcaatttttaaattactgatattcaaccttgctgctcgttactggtatgttcagggtttctttcttttttttttttttttttgagatggagttttgctctttcacctaggctttagtgctgtggcatgatcttggctcactgcaacctccaccttccagtttcaagtaattctcctgcctcagcctcccaagtagctgagattacaggtgcccaccaccacgcccagctaatttttgtatttttagtagagtcggagtttcactgtgttggccaggcaggtctcgaactcctgacctagtgatccacctgcctcagcctcccaaagtgctaaaatcacagacgtgagccaccgcgcccagccaaagcgttcagggtttctatttcttcttgatttaaactaggagggttgtgtgtttccaggaatgtatccatttcctctagattttctagtttgtgtgcataaaggtgttcatagtagtagtgaatgatcttttgtatttttgtgatgtaggttgtagtgtttccagtttcatttctacttgagcttatttgaatcttctctcttctttccttggttaatcttgctaatggtctatcaattttgtttatcttttcaaagaactatttgtttcatttatattttgtatttttttgtttcaacttcatttagttctgctttgatctttgttatttcttttcttctgctggatttgagtttagtttgttcttgtttctctagttccttgaaatgtgacattaggttgtcaatttgtgctctttcagaatttttgatgtagtatttaacactatgaactttcctcttagcactgtttttgctgtatctcagaggttttgataaattgtgtcactattaatcatttcaaaaaatattttaatttccatctcaatttcattgttaaccccaaaatcattcaagagcagatttcttaatttccatgtgtttgtatagttttgagggttccttttggagttgatttttagttttattccactgtggtctgagaagatacttgatatgattttgattttcctaaatttattaagactttgtggtctcttgtatgacctgtcttggagaatggtccatctgctgataagaatgtatattctataattgttaggaagaatgttctgtaaatatctgttaagtccatttgttctagggtgtaatttaagtccattgtttctttgttaagtttttgtttcagtgacctgtctagtgctgtaaatggagtattgaagtcccccactattattgcattgctgtctatctcatttcttaggtctagtactattgttttataaagctaggagcaccagtgttaggtgcatataaattgagtactgtagtaaatatcttcttgttggactaatccttttatcattatacaatgtctttctttatcttttatttacggttattgctttaaagcccattttgtctgatataagaatagctactcctgcttgcttttggttcccatttgcatggagtatctttttccgtccttttaccacaagtgatattttgatacaagcatataatatataatgatcaaatcagagtgattgcagtatctatcaccttaaatatttatccattttaaattttaaaaggaaagctatattcagaaatcactttttcttgtaactaattcctgttcttcataaagcagaaatttcatagtttgatatagttgtcttaacatttaatgaatattttcaagcaaagtatatacaatggagaataatgctcagctgcaaaagtcacctataataaatctgatttttccatttacaaacaaaagaattcccaaagtttatccattttggtagaacacgaattcactctgttgagtttggagctcttgtgcggaaaaccttggacctgcaatttagttagcatattcaaagttttaaaattatggagatgtagtcaagaataggacttgataactattatcccactgatacgctatttaaataagttgggatttaagtacttatttgatttccttaaatttgcttatagatgattaacatgtattgcaaattgttaccttttacagatttctattgagcactgcttaaattttattatatgatgaacacctgactagttgctacagccaaacattttttgttatgcaaatgaattttacagcttaattggaatgatgagagaattgaaaatatgggcaaatgccagagaagtgaaaagcaaaatgaagcaaaacaaaaaagaacttgtataatatataaataatccatttcaactctacagtacaccaaactcttgaaaaagtagcaagattgtttttgtgaacagccaaatcaaaaactgtagtcatttcataagtatttgctaataattataaaagattggaaattatacagttctgagcttattgaacctttgacccattgcagtgtcctcagacatttgtgatacattggtagtgccatttaattttaaaaatccacctctacattagagattatagtaacccctcatttacctatctggaaataagagtgggaaagataatattagagtaaatggacagactatttagagtttatgtattaataaaagagaaattgcatgtacaaacatgttattttctaggtaactaaaacctagtcctttaataaagcactgaaaaaaattttatcgtaactattttaatgagaacttttcttgaatatcttctgttttgcttcattgagcagcgcataatatctaaccaacaaatttatagtgctttgtagttcacagcatttttaccatataaaatatctcgtttagtttctccaacaaagctatgagttaggtggtattattatatccatgtttcaaggatgataaatcttagtgacccatctcattttccaaggatcacacaaccagtagtagtgaattaggaacgaaacctaagacttctgattctaaatcacaatgtaaattaacttttcttaattttcaggggtgtcgttatcacatcaatttttgctctgtttagtgatacagtgttatatgaggaacatgaaattcaaagcaccctttcttcagttgagacccagttgaagtggttaatttgcttttagaagctagactgtaagataaatacatacctttaagtattaaagctaactcaaatcactgagatacttacaccatgagaagagagtggaacctaagtcaactggtagaaacatagaaacagcaaactttgatctctctttatcctcattctgaggggcaatatgcttactgagtggaaagatgggcatacccccagcagtatttaaatcaatccctaatctatcactatctctccttttctctctatctcagcacatataggtgatttcctataaattaaatggtgtaggatgagatttcatcccatgttgaaaggtcatttcattgataaatgactaagattaccacatttctcagttttaagtttttcatgttcattgtctcctattgctactttctgttatcagaatgattacttctcattgcttttagtattctgtctttgtagggttacagaaacttcacagggaaaccagaagatcaaatatattactcactagtctcttagaatatttaatttttagtgtttaggttctgatgtcaggacaggaaaatatcttccgtgagtgatgacttccaagggtggttttcctgactaatcagaggcattattttttgtttgcttttgggttcaagactgatttttaataaataaaaaagttacatttattgatatgctagtaaatatttacatcatgcattctggataaaaacattgaaagccttgatttgacttgatgtcagacacaatagacatagtctcaagagcactgatgatagttaaattaggaagtgatgaattcttactatatattatcttttgttcttagcacagtttattttatatttataaaatttaatttatattaatggttatgtttaataaccgattagcaaaattactgaaatgtgacaataatatctctattcctgtttctttcctgctttatccttttaaaatatattatttataagtatattttaaatttataaaagctacattgtgctataaatcttgtttcttagcttttctaacattcataattgtgttttaaagatccacccatggccgggcgcagtggctcatgcctgcaatcccagcacattgggaggccaagatgggcagatcatctgaggtcaggagttcaaggcagcctggccaacatggtgaaatacaaaatacaaaaattacccgggtgtggtggtgcgagcctgtaatcccagctaccgggaggctgaggcaggagaatcacttgaacccaggaggcaaaggttgcagtgagccaagatctcaccactgcattccagccagggcaacaacagtgaaactccatctaaaaaaaaaaaagaaaaaaatccatccacattgctctacatatacccttatccatttctttcacatacatacccatgttggcctcaattccccacaatgcagcaacaaactttcttgtacttccttatgaccttaagaatgtgagagaaacttctccggtatacactggtgagggaatatgatcagcagggttttttgtttgtttttctgtgttttgctttttaacttatgcccacctttctgttggcagtcagcagccacatctgaagttatagctctctgatttagacaaggcttattcttccctttgttacaacctagtccctatagggacctgaatttgtgaccctagtctatgagattactttttaaatacagtttggttcaggatttataaaagcctaataaggctgggtgtggtggctcacacctgtaattccagcgctttgggaggctgggatgggcagatcactggagtccaggagtttgagaccagcctgggcaacatggcaaaaccccgtctctacataaaaatgtatgtactcagtagtactactcagtagtagtactgagtagctactcaggaggctgaggtgggaggattgcctaggaagtcgaggctgcagtgagccgagatcttgccactgctctcccgcctgggtgacagagtgagaccctgtctcaaaagaaaaaataagcctaataaaatgattgcacgcctggaaaacctacataggctccttcaagtcccatatatatataaagtcatccatggtatgtagttcacattgaagtcaagttgggggaaaagaaacttatttatctctttctcttttcctttattcaagtagcaattttcatttaattttattcaattcagaaatatttactgaactcctcttattaggaagcactagactggatataaagaaaacatcgtacaaggcatagaggactcagtcctgccttgcgaagggcacatagtctgactggaaagacacatgctgacagggtagactgtgttaggaataatgctcaaaatcctgaggacattgaacactcgaacaaaggattcttagcaaagcaattttacttctgcacagaggggtgcctccttggccagttgccatgagagcacacctgaacaaaggggcatgagagcctttattcctgacgcaagtcctgcccctgtaccctttccccccattggctggggttgggtcgtacaatctaaactaatcccagttggctaaacatttgatttttttagatagggtgggcacgtaaaatcaagtggagaggaaggggaaggggcgtctgtaatgagctagaaagttagtcctctttccaaataaggaaatgaatgtgagctggtactgaggtgtgcctgggcatctaacaaaggtaaaaaggaaaaaggagaaaaatcagggggtactatgaattaaagaataaaagattgatcagattatttgaagagaaacctcatcatatcccacaactggaagaaacaatttgatggcaagtttctcttcgtcgtttaccagctcaaaatctcaactatcaaaggcaagaaaaatacacacacacacacacacacacacacacacacacacacacacacacacccctctgcctttttctgtatggccaaagccttcagtccagctgaccacttcccactccagttaccatgttagcctcccaacttgtatctctgcacccttctgataaagcctccacaatgcaaaacacgaatcgtatcatatggctcttcttctctaaacacttccatctactctgtggttttagaagagaatgtaatagtcccacattacaaggtcttaataaattgcattcttgcagctctgtatcattacttgtaaacactgtagtctagatagccaggacacactgcatttcttttttaaggctcgatacctcttgccattttgcacgtagttttccttctgtctgaaatgccctttttccacctggcgcttgaatggccccttctgaaaacttcctagtcgtctttcaaaataaattcaaatgttagcttttgtgggtaacctattgacctctccaggctgagttaagctgttcccccgaggtgtcttgttgaaatcattattttttcctaaaatctctgttctaatttacttacatgtctgtgaatgcttagaggttacgaacttcagttttgtaagcttagtaactggcacaaagtctggcacagagtagcacctgaacaattatttttctggaataaataaagtaatggtttcattgaaatgattcgcattaaattaatgattagcattaaactacaacgtgtatatgaaacattccagttaggttgggttcattccattcctatttaaagagtttgtagtttctggctcttttccaactctgattcttcagactagaaatgcaatttctgctaatgtatttattttaaccaaacccgacatcaatcaagttatttgtattcctcataaggtaagcataggaatttacagtgatacaaaaacgcagctattatctcttataggcactggtaaagcttttgtgactagtgctactatactggtaaggtattgctgcttgtaatgaactaaatatttcagtggcttaacacaataggagttcttttcttgctcacatgacaacccagcgtatgttttcctagtcaagcagctttcttacatatgttattgcagaaacctaggtcctgttcatcttcttcctctgcctgccattcccttggtagcttttctctgctcgggtttcgcaagaggatgaaatcctattgaaaatgatctgagggtctattatgttctcaagaatggtacatatctagtctatgataaatgctcaggtaactgattaggtgtaatagatatcttaggattttgtcatgaacaatcagcatcaacaccacctggaaaattgttaaaaatgcaaattattgggctccacccagtatctactaaatccagaactccggggctaccatgcagcaattagcaaggtctccaggtgattctgttgatcctaaagtatgagaacaactgccctagggcgttaggacttaattctctcctcagtaagttgtaaagatttgccgtaggacctaagagtcttctgcttccagcaatagaaaggaaaaaaaatgtggaaacctcactaaatttttcaaagcctcagccccaaactgacaaacaacacttctgctcacattctgctggctataaattatcgtatagctagctgcccagtgaagtggaaccagctcaggacggcctactgttatattgccaggcattttttgagccacttgatgttatcttcttggtaatttaaatttaaccgtggtaggaatatttacaccacagaaattggcaaacactaaaaacaaggtgtttttaaacaccctgagatcagagatccagttgatatacatctaccagcacaccactggccatatacaggcttgccttatgccacggggagctctgcagctgaagtagcccttcaaacttgtcctgctttgagccaaattaggcctctatactttcaccttcatcagtcactgaatgagggctgcctggggaaaggcatgaacttggacaaggcagctctctgcagctcaggcagtccctgaagggactgacagttgaagaatgtctactgacatcatttccatcatctagaacaagagtctttctttgaagggggctctgagtagcatattcccgtgtccactgcagcccctccctttaagagactctgatataattgactgggggtgagccagtacattaggattttcctaaagttatctggataattttagtatgcaaccacaatagatactcttcaagaattaagctagttgctgagagggaactgttttttgttggtttgttttcactaatgtttgcactctacttcctttaaataaaattatgcctggagaaagggtttttgtatggagcaattgataaatatttgtagggtggttggctaaaataattataattcctttaaaagaaattctacccactaaagttaatttagaagtaaaatataatagaaatccaataatatattcaccaaatggattaagatgttcatgaattatcttcaaagtgttaatcgaataagtaatgtgtatgcttttctgttaaagaggaagttagaagatctgagctctgagtggaaggcggtaaaccgtttacttcaagagctgagggcaaagcagcctgacctagctcctggactgaccactattggagcctgtaagtatactggatcccattctctttggctctagctatttgttcaaaagtgcaactatgaagtgatgactgggtgagagagaaaatttgtttcaattctaaagatagagataaacctttgtgttattgactgtgcaaaaagtcttagagtacattccttggaaattgactctgattcaaagtgttgcatgacaacgggatatggggagtgttctctggagatacacccacaaggaagagaagagcacaagggagattgtgggagagtctgaaatgtgatttgtctgcagcagaggcctaagccagtctcgcaggagccctacatctgggctggctgtgcagagctgtcctgaattgcaggcagtgggcctggcccttgtattcctgatccagccagccattggccaggggctggctgctgcctgagagtggaaggacaacttggacaagttttctgaggccgaaggcaattcttagtaaggaacaccattaacaaccaatattcctagcatccagggatgtgtgcattgttcctgaagagggacaagtatgtctacaaaaatcacagaaaccacagaaacacacacagtcctactagcacctctccctgtcccatttgcaaacaatttaagagctctcccatttttagttcaagaaaaagaaaaatggattgggaggaccacaagctgacttgggggaggaatatttcctcatttagctgtagttttaacttttgttttcactgcatattttcagtctattttattttctttcctcttcagttgttgatagaaggtattcataaattctcatggcaatgttaatgctggctttgactctcaggggaaagaggccagaaaacttctttgctgtaccattccataattaggcagaactaaaaacatctttgggtgttgttttttgtttttgtttttttttttgccttgtctgcttttcaaagatcaaatgattgaagcattaaagcatggtgactggttcttcaggtaaagttgatttttattttatgtcaagtagaaaaatactgaactggaagaatcacagctggggtagcacaatcataattcattagaaggcataaatagtgcttggattaaaagaagccctacaatctggggacagtgcatctcatgtgccctctgggattactcggcagtcatcagagttagatttaacgactttggagacttaagcattatggttttttttttttgtcaatctgggacactgaaattgctgtatcagggttatactcaactgtgtcaggtttatttgtttttatgagctgtaatttttggttccctcagcgcatatgcatagtttgttcctatgttatcatttattggtgtctgttttctggctgtctctggtaggttcagcctcagactctgtaactccatgaagagattatgttccaatgatgttttataagtttgttaaactctgaactcatgagtttatgtcccatataagccacgttacacatggtaggaaggctccaaaaccagggcgccgaaatccatttaacgtgtaacttacctaaatgtaacaatgtttataagaaaaatacattggaagttccagttttgacttccagcaacatatataattcatccactttatttattaacttccatgtgttgagcatcatactggtgctgcgagtacagcatagaataaaagtctctcctttcataaaacatatattgtaattgaaagagaaagacaataaactaatgaagaaaatatatactgtctcaataattataagtgctgtagagtgtagtctacagattgatgtcaatgggtatttgttagacacacagaatctgaggcccctatcctagacccactgaatcacaatctgcattttaatagaatccccaggtgaatcctgtgcacactgacatttgagaaacaccattacagagaacaactaagcagggagatgggatgagggtattattgtctatagtgtggtcagggaagcttgtctgttaagagaacatcagaaaactgatgtaagtgaggaagtgagcctggtgtatttctgggaaaattattccaggcagggagagaaaagactgagcaacgatactgaagtaggaacaagatgacggaatattaaggagatcagtgagactagaggagtgggtcaggggaagtgtgatggaagccatgagagatactcatctttcatagcactgccctacttccttctccccaacatgagggtctcatcaccccccaccactcttgtcttctcctatgtcctccacattgctgccagtatggagagtctgggaatgccctcagctcaaagctgtttggtgatagctggcagagttgtggtagtagctaaaaaagaattaagggaaagaggaattttctcaaaagcaggtgcttttcatcctctttagcaaaccgaaacagatctgagcattaagtcaagatgttaaatacacaaatgttgaatgaaaaaaaaaacaaaaggtagtcatttaaattcagagctgcttttattaaaataagattttcttttttctttactgtggtagttcaaatatcagaataaagaattgtttctattcccgacttcctgacttgcaggaagttaatcagaaataaatgcaatataaaaaaagaaaatctaatttgtattatgcttcttgtatatgtttattatttcatgtactgtattacaatgtaatagaatttataattcattatagcagattgtttccattgcattcctactattaaatatgtagaagctacacatatacttgtagctttaacatatatgtctttatcctcaaaataactgcaaagaacatatagataatttttaaagattaaggagcctgaggtttagaggggagatagctagattaaggccacacagctagaaagcaagcaagcaagggtttcagtccacatgtcaagctccacagcctgtgttttgttttgtggctgtgctttacactatctctctgtccaagaacctaatggaaaattacagatacagatgcagctggccagcagttaatataatttaactcaatcttaaatttatctggagtaaaagtgatacaagtttccgtgttttttcttttctttctttcttttttctttgtgtgtgtgtgtgtgtgtgtgtgtgtgacagaatcttgctctgttgcccaggctggagtgcagtggtgcgatctcggtttactacaacctctgcctttcaggttcaagcgattctcctgcctcagcctcccaagtagctgggatacaggtgcgcaccaccatgcccagctaatttttgtagttttagtaaagacggggttgctccatgttgatcaggctggtcttaaactcctgacctcaagtgatccgcctgcctcagcctctcaaagtgctgggattacaggcatgagccaccttgactggcctgtttctgtgttttttctacttaagaagtagaaaaaattggttcactctatttgaatttcttagaaccatagaaatccaaacttggaataattattgcaattattatctagttgagtattcttcttttatagatgtagaagctgaggcctaaagttgcttgttttgttttatgaacactaaaccaaactaccttgtggctgcttacttaaattataaattataatggggtggccttgcctgagctgtataaattgttttaattatcaggacaaatcaacatactggaaaaaaaaagcaaaacttgcaattgttgttgcttagacacctgtccatatcagtttctattgttgcatagaagcaccccaaaacttaacagttcaaaacgagtgatttattgctcataattctgtgtgtctgaagtttgctctgtgattagctggatagttattctgatggtcttgcttggtgttacttatgtggatgcagttatctagcaagtgaacaggagctagatggtctaaaatgcactctctcagatatctgacagctggctgttggttgcagaaccttgattcttcataaggccactcatcatcctgtaggctagattaggcttcattacatggtattctcagggcagttttccaagagagggcgggtggaagctacaagaccttctgatgcctaggctttgaaacgtgtaggttacttctgctaagttatattggtcaaagcacctcaaaagatcagcccagattcaagagatgaggaaattacttcatctcgtgaaaggaggagatgccacatcgcatatcaaaggggtatgcatattggggatagaaggttttattgtcaccgtatttatacacaaatcactacattggggaaaaggagggaaactggagatcaaaagtgttggtcttaatccaacttaattctcaaaaattaccatgcgttagaaccacccagttcttcgcaaagtatagattactgggcttcaaccccagagtttctgatttactagctctggggtgagacctgcatctctctctctctctttttttttgagactgagtcttgctctgtcacccaggctggagtgcagtggtgcaatctcggctcacagcaacctctgcctcctgggttgaagcggttctcctgcctcagcctcctgagtagctaggattataggcacccgccaccacgcctggctaatttttgtatttttagtagagacagggtttcaccatgttggtcaggctggtctcgaactcctgacctcaggtgatccacctgcctcagcctcccatagtgctgggattacaggcgtgagccactgtgcccagccaagacttgcatctctgaaaagttcctaggttatgctgatgctggcctatgctttgagaactactaccacagacatacagtgagtggggaagaataaattcatcccttctgctgtgtgcagcaaggagtgggattccaatgagatccagtgctgtgaatgctaaagggaaatccatcttattttagcacctctactccccatctccccaccccgaggatgttatagcttagaagttcaaggagatggacaacacactaaaccaggcagtatttgccctgcagagctgttcagtgttcctggatgagacctctgagaagaaaagccataagttcctctagagactttcacaatcatttaggtagacaggactttgcatgggtctgaaggcttgcatggcagatggaggcaaagagccagcaaatctggttgtaaatgtcaatgtgaatcctttcttatccacaagctgctgggcctgagaacattaatgttctacaatacccgatttagcatttttgaaagaaattgcatatagacatgcttaatgtgaagactccaaatcaggatatttgattcaaatgtctcttggtaataactatggaatgaataacccattgtatatggacatatagaagagccagttaacagagttttctttttttttttttttttttttttttttttttttgagacggagtctcactctgtcgcccaggctggagtgcagtggcgcgatctcggctcactgcaagctccgcctcccgggttcacgccattctcctgcctcagcctcccccgtagctgggactacaggcgcccgccaccacgcccggctaatttttttgtgttttttagtagagacggggtttcactgtgttagccaggatggtctcgatctcctgacctcgtgatccgcccgcctcggccttccaaagtgctgggattacaggcgtgagccaccgcgcccggcccagagttttctagttgattaaacactggtaaaatcatctcttcctgtaattaagtttggagagagcaagtctcaagtgtaattaggaaagcacagtattggaggtcaagaagcctaaattctgatatctcagttgtgctaccaactatataagggatcaacagactgtttctgcaaaggaccgatactagatattttctgctttatgggtcatgtggtcaactctgtcattgtatactaaaagccacagacaatacctaaataaagggacatggctgtgctccagtgacactttatttacagaaacgaggcaggtaagatagatttgacccttagtgggctacccatttccccttagcactcagccttcctataaaccatgaagcgtctaactacaagtacctgtgagtcttcctgagtcctttctctgcctgtaggagtagctctcccacttgcagagcaggctggaagctggggaggagattatctctggaatagcacttaaccaatggacaaaagctgggggataaaggtgttggtcttcatagttttcatactgctatgaagaaatacccgagactggataatttatacaggaaaaagaagtttaatggactcacagttccacatggctggagaggcctcacaatcatggcagaaggcgaaggaagagcagaggcacttcttacatgacagcaggcaagagagcatgtgcagggaaactgctctttataaaaccatcagatctcatgagacttattcactatcaggagaacagcacaggaaaaccccacccccatgattcagttacctcccacatggtccctcccacaacacgtggggattattggagttacaattcaagatgagatttgggtgagaacacagccaaaccatatcaataaatatcccaccttcttctccccttgggtaggacacctccaatgcatgttccacactaaaaatctccagtgaattgggcagttgaccacaatgataagcatacttattagcatgcctcgtataggcttccttccgatgtgtaggctttcttcccattttggcagaatctggacccaaccccacatctcctgagtttgatttcagtcctcttcagtattctcatatatctcaactttgttccctgctgagatacaactgacagatatatatgtatcttcagctctgcagctctatcttctcttctaccatggctttctgggatcagctcccaattgaattatttgtatttaaatccttgtctcagggtctacttctgagcaaacctaaattaatacaagtcttagaattagtgccacagttataccttttgagtaagttatgttgcaattcccattttatagatgagataaccaagggtcagaaaggttaaataatttgtccaaggttacagagctagtcagtgacagagtgggtattcaaaaataagtctctatgattccagagcttatgctattaatcagtgcaccatgtatcaagcagtgatttagttatcttcatttgaattttttgaagtctctatttaaattgaatatcaaatcctcacatataaggttatttatacctttttatttgttttatttatttatttatttttgcttaacttttttttattatactttaagttttagggtacatgtgcacaatgtgcaggtctgttacatatatatacatgtgccatgttggtgtgctgcacccattaactcgtcattgaacattaggtatatctcctaatgctatccctcccccctccccccaccccacagcaggccccagtgtgtgatgttccccttcctgtgaccatgtgttctcattgttcaattcccacctgtgagtgagaatatgcggtgtttggttttttgtccttgcgatagtttgctgagaatgatggtttacagcttcatccatatccctacaaaggacatgaactcatcattttttatggctgcatagtattccatggtgatttatacattttaatttgaacttcactcacctctacaaagttaaataaagcattccatttccatttcaataatactttaaatatctaggcagttaaagcatgaggttacttggcacttaaatgtactcttgtcatactacttttgttggcttaaattgcaaaaaaaaaaaatggttaatttattgtgacaataccctacatttatctgcagtgatcattttttttgtgaaaatggccttcgtttatctgcagcaaaggaaaaagaggatggcaattagttcttgcattcttattcctctcttgggtcctgatccttctcattaatagaaacatggcaggggaggggtatataacccacaccctttcctgttgtggttatgtttccactgttgattctgcttcaggtgaacctttaggattaggcaaataaatttccgtgaggccaaatctttttcttcctcattaacagatgatttctctgctaaaaacacttacgacatggctatactattgccggttttatagttacaggctctaaaccttgaaaacttcctcaaagtctaatacgtcaggagcaagcttttgtacaaaaaatgtgaagacccttaatcagttccaataacaaaataaatccattttaaaccctatcccaagatactgcaaggccttggagcagctggagagactccttaactcttgacattaattaattaatttaaaaattcatatttgtatgtatcagtgaggtaagagtgcttgaaatataatgagatgtgtcacactgtagaaaggggagtgacaacagaaagccctggctggtgaggccccagcacttctcacactcatcagaaggaagtctttccatgaaggcagtagggggtccctggtcccaggccaggtccttcaacaatgctcactggttaacaggaaaggcactacagtggcatcattgttaacatccaagacagtgatagaatgtgaaacttctactgtttagtatttagtattcagcatttagatgttaattatccattttgtgatgaagttccctttcttctccctctcttaaccttttggtagttttattgcatggttaccatttccagttagggttgtgctttggggtctgaactgatgaaggaagagaaactctagttcatcatttctaggaaaaagagaaggctaacatcaattctgatgattagagattttttgattacctatgtcctgcattttaacagaaataaaatgttaattacagtaaacttactttaaccttcttatgctatttaacactcttcaagaaaggacttttgcttgaaatcactacagagtataccataatcttgactgtcatactctgaccaagaaaccagaactatttaggcatatttatgagagtaagtaccctaccgctcaaaatggaaggcttcaacatgtattcctaatatttcctaaaacttcactgaatagttttaaaattgaatataactttaccttcagagagaaacaagatttcgaaaggaaattgtagcagttttgtacttcaattgtcgattttaagattgtggtctgaaaagtatttgaacagtcattctttcttttccactatctcaggaaaggctctcattctattagaagcaatcttagaagcgtaactgccaactctcttcttaaaaagtgaagagcagatggagttctaccaatctgctatacttgacagtttttcaactacctaacctaagttccagttactgtctaaattatttttattcgaataggaaaaatacatttatgcttactgtacatttcgacagtgttcattctttgaggtctgttatttaatctccttcccacttttcttttctatcttaaatcagatgagtccccatggtctggcaacaaaacagctgtttctcaaatttttaacgtctctgtggccctcctcctacccttccaagtgttttccatactatttttctgttgtgggcttcagaattggatgctgttccataattactggtcttcccatgactctgtcacatcataaagtctatatatacccttttcctacgtttacatgccaaataccaggtgtgtctagctttaattcaatgactagcatatggtaggtattgcactaatattttttggtcaagtgaacatatattttacagatagatcaaatacatcaaccttcccatgtaataataataataccaagaagattaaatgatcgcgtgcttgaccagctgtttagtggcagaatctggacccaaccccacatctcctgagtttaatttcagtgctcttcagcattcttatatatctcaactttgttccctgctgagacacagctgacagatatatatatatatcttcacaatctcagtagtaagccctatttttttaagattacagtgctgatcaaagagggatattctatggcattgatgcaaatcttccaggccagatataacccctatctccttaaaccctcattcttgactgtgtcttgaaatcaaatttgagaacctctgctttacatgctaccttcctcttaaaattcataaggtttattccttctctcatcttcagtatttttatgaaaatatgttttactcttatttccaaagtgcttgccagcccatgctgagttcattagacaaacaatctaggtatcctaatatttaggtaaaattgctagcagcactaactataccagtacccacttaaattgcaatataaacctacaataggaaaaaaaaagtcaaaattatactactttcaattcctacttctggaataattatcacaccttcaaaaaaactcataattgttctccaatattaaaaaccaggaactaaattacatcactatatatatatagctatatagacatataactgtatatagtttatatatatattacatgtcactatatatggttatatatacagatagctatatctctatatagtttttatataggaaactatatatataaactcatatatatttatatataaactcatatatatataaactcatatatatttatatataaactcatatatatttatatataaactcatatatatataagagattttatatgtatatatgagagacaatattgaaataaaacaaactagccaatctccaatgtcccttcattttcccaggactcttctttattctcaaagaaatgtatgaatacacaatataaataaatgttctataatgttcattatggattataatagttttcttgtcatactgaagtgaatgggaattgtttcttcgattattagcatacttttcataactatgtgatttggtgataggcacttttgcttactaagttcagcatgatcaaaacagaactcctattatttttattgttgattcttatttctttaaggtaaaatatgcccttttcctttgaacctgcacactgtttaacaaataagcacataactcaggattgaattgtacacttcgatttgagcttttttttcaaggtcaggacccagtttcacaagaagttttattttttccaatacaactgacatccactcccaccagctgaaagacaagaaaaacttgtctaataaagctttcagattcaatttgctgcctgcatacagcttgaggaatctctggaggtcactcacagcatgtgttgcaaccccaacagggagaagtaatgaaaagattctagttaaaaagctgacactgccccttccaacctctttgaatgtgaatataataagccagtttacagacgcaaatctctatgattctggggatttccatcttgatctctgactccaaggaacatttgaatgcatggatttgtatccattatctgggtgaataaatgcttcatattgaaaaaaggggtgctttaacaacataagtctgatgtaaatcaggcaaaacaacattgtcacttcatgtttaactctcctggagggtctctaaggtctcacagtttggttctattccagtaatatataggcctatcatagccattttcaaaaataatacctgctttcatttcgattattccccctagcttttgcattgacccgaacatacctaatatttatcttagggctaacacgcattaatgccttgctctgtaccaggcattttgccaagtattctttgtgcatttttctgtttaatcttacagcagccttatgaaataggtactacattattattatttttcaccatgagaggaaatgaaagcctagagagaatggttatccaaaaacacccagctactaagtgggcacagcatggccttgaacctgagtctttataaagttcatgcctgtcttttacctttatgttaaacatactgaatcttggtcatgcagtctatgaatgaagactccatatactctaggaccaattctaccatattgtgcatgcttttgtacatattttccaaatgaaattaaacaacaatactctctcttcccctttcttttccgttttgcatgacatctaaatcttttattaaatctccgtgggtggaattgggccttaagtagtagtacctttgaagcttaatactataacctcagagttacggaagtggtttcaatatgaagaaatatatacgttcttttcttttcttttcttttctttttttggctcctctagaatagaaggcaatcaggagagaaaaagacattaagatgataggcttgattctcccacagtgttactacttagctttatttattctcccacatctgtaactgtcaattcaaggtcaaaaagccagtacagcagcagaattacaaaaagtagatctggaaaatctatagggtaccatagtccagcaccctgctgcaagtcaaaatcaattaaataaatatgtttaaacagcacttcatttaatcttaagggcaccacgactcccttggaaaattcttttttgtgttcagacctgattctctgaaagtattttctagtgttttctttgttcggtggctgtggtgaataagtggacccaattgcctacagcatgaaatcgtagaaatgaatatgggctggaacttcaatcaatcacacaaaccagaaacatagagttcatcacctcttctggaaagcgtccccttcggccgtcaaaagggtagagtttcctccaacatatgttcatacttccctttgcctcccatctgcaatttcaaccagtctgttgctctcgccctttttaggcttcacataccggatttcttcttaggagctcacttgaaaaaagggttgtatgctttaaaaatactaaaagtcactggactagatgataataaaatttctgtaaaataaaaagggagttaacagaggtgttaccacttatcataatggatattgttgacctttcctctagccagtgtcccacttaagcatgcttcttggctggaatttatttttctcatctggataaatctgaagcattatagtaaaacccagtgtgagcaaggccatggatgcaagtggattgagatgaatgagtggatagacctgcgtgggcagaaataatgaggtcagcaataagccataccaagggatgcacactcaaggaataaattggaggtagcagaataactgaacaaatgatacatttgatcagactgtcacatgaatatcaactgaaacaagttatgactgtagttagtgaaccctagagtgaagaaaacaaaatattgaaatccatctgatcaaaaaataataaaattgtttacatgtatatattatctaaaatttcccttaagaatgaagattataaattcccgcagttgaggaaactgaataagaggagaatcaggacagaatcttttctcttcgtattcctagtccatttttcttctaactacagtagtgagaacaagaatttattcaccaaatcataatacattgcaattaggggatgccatttgaatcttggaagacacgatttgaggcaaataaaaaatccatatttataaagtcaattattggtttatataatttactgtttcagcgggaggtataggttagtaatgtaagtcacttcaagaaggttttggtcgaagttttgccaattttttctgtaaaaagccagatagtaaatattttgggttttacaagccagaagatctttgttgaagttactcaactctgctaatgaggtgcaaagcagccataggcagtttgtaaatgcataagtgtggctgtgttccaataaaagtgtgtttgcaagaacaggcagttggttggatttggcccacaagccgtagttcactgacccctgttttagataaatactagtcaatagattccttgtagctaataaagggaatatagattgtttaatgtgtttccctaatcttcttaaggcttcctccaggggaaaaaatatttcttatcatcagcagtgttattaatgcttactcagaacaaagaataccacttacttagcatagaatggacatttataaagccactcatggaaagaataaagagatgtgaaatacctggtacaactcttaagagtgttccactatcatttgaaaaaatgatgagtagtagttatataaaaggactcgagcctaaaacatttgttctcactttggataacgttttcctatctcagcatcaaaaaatacaaagaaaggggataactaggtcttagattttctaaattctcatgactataagtcccatatatttagatattgaagtacccttaaatatacctaagtagaagtaataatttcgatattatgggaaatctaattactgctcatagttctcgagattaaaatgttatacaccacatctcagctttctttgaaacttgaaatggcatacttgtacaaaggtagaatggtctcccaaagcagcgtcatagattagcagaaaagagctatgataatgccacttcaactgactatcatttaaataatgaattagttaggaagagttaaattatatagttacaggcagcaggagatgtcaccatcagggggataagaagccattttccagtacactatttgacttaactggtgcagttccttctttaactgtaggttactcatttgtatccttaatttatcaatatactaatctgacaaataatttattaaggattactgtgtgccctcctgtgtgttagattctagggatacaatatggatcaagataagcgtgattcctagactcctagaaagtaagaaaactaaataactgtacgtgacaaatactaggatgtagaatactagggaagaatcaggaagaatcacctcacccagtctggagtattgcaacagagcgatgtcagaggaaaaattctggaaaaaaaaaaaaaaaaggaaatttgaagatgagacttgaaggataagtaggtgtacctaggcaaacaagtaggggagagtgttccaggcaagagaaacaagtaacagttggaggcaaaatggagcctagcacgttttaaaaatatcagtatggctgaagcactgagttggggttgggaatgggtgaggagcgatgtgtcagggaggacattccagatgatgctggaaatgcatgcatgttcgcaaactgcattttaagacatgttagagaaatcaaacacattttatttgaagggtaattgaaagccactgaagcattgtagagagactagtgacatgagcatatttgggttttagagggattactctggctgaagaataggtaactgattggataagagcaactttggaggctattccagtggttcaggtgatagataataatgacctaaactaaagaagtaataaagggaatggagacaaagtagacagattcaagtgatacttggcacgtggaaacaacaggccctggtaactgattggacataaaatggagagatacagagaacgcgaatagaacacccaggcatttggcttgataaaccgagtagaccgtggtagaaattactaaactatggagtattttagggttcaggggaactgtgagttcaattttagacatctagttttgcaaggccactgaggtaactgagcatatgagtcaggagagaagtttaggctaaaaatatggatgccagagttaaccagcgttatgataaaacaaagctgaagtctcgagggtaagaacacctaaacatctaggctggagaaggcagcaggtaaaaagtaaaaggagaggccaggcacggtggctcacgcctgtaatcccaacactttggggggccgaggtgggtggatcacctgaggtcgggagtttgagaccagcctgaccaacatggagaaaccgtgtctctactaaaaatacaaaatcagccaggcatggtggcgcatgcctgtaatcccagctactcgggaggctgaggcaggagaatcgcttgaacccaggaggtggaggttgcggtgagccaagattgtgccattgcgctccagcctgggcaacaagagtgaaactccgtctcaaaaaataaaaagaaagagagagagagagagagagagagaaacagagaaagagagagaggaagacaaagaaaggaaggaagggagggagggagggagggagggagggaaagaaaagaaaaggagaaaaattcaggagaatggttacttccagggagatggaggcgattgtgctgtggggaacacaagggtggggtcaaggtattagcagtattctatttcttgattggggttgtatttacataaagtgttgctttataattattcttcacactttatgtgtacgttctatgtaatcatctatagataagacagatttcactgtaaaagaaaataaaagcttccaaaagattatcatcacaattgtaacagattcccctggtgcctggagtcacacgccattttcctgcactgcagttgcagctgcagtggacagccctgtgtgagttcagacttgcctttagctgacagcatcccatgtcaagggaatggctcccatttttctactttctatctaagggacttctctgacatcccaggagcccacagattttgtgagctttctcacccttgaagttttagtgagtgagcaaccttcaaccaatggagatgggagcccatggatatatttttaaccactattccttccgggggcaaggggaattctctgtgattctcaggaacatacaaaagttctgtcaaaatacagtccccatggtccataagcattaccttgatgataatacatttgattggcatttcctccccctctgtctcactcttttggtttttcattcttgcttcctagggatcagcttccaaatgagctatctgtacccaagtcctcatccaggccctgttttcaggggacccaaagacaacaataagaaaaatggaactgaaagaggagaagactttaaggcatgaaaaaagttcctctgtattccatactgcatatttaactgcctactcaacagttccacttagatgtctcaaaaataatctcatgatcttttactgctatgaaatgcatgaccttcccctgatatattcctttcttcaggttttgtagcaccacttagctatccagtaacaaaatcttgggggtcattcttaaaaccttcccacctcacccctgctggacatccaccactaagttcagttgatttttttgctcctaaatatttcttggttcagctttcatttttagatttatcctgcatacccctgtacaatctcatcatctctttcctggactgttacagtagtcttatattaggatgatcatagtcttgatttgcctagagaaaacatgctttatgtcattgcctcagagtgactaatagtcccacctttcacttgtaacactatgcaggttattgggttaaataatactgtcatccaaacctaatctctcctcattcatttcttctctcctatgcatcttagctgtgtgaaaattcaaaatataaatttgatgacagacagaactctgtttaaaatgctccagtaccttaccatttatctcaaaataaaaatttcaaaaaaagaaatgatatcccacaggatcttgtatagtgtgaccctttccatttcatcatccttataccagatactgtgaactacttactctcttatctccacattgacctccctcctagttttgttttgcttatgaaagtgcttattttctgttttttaaagccattgcacatattggtctctctgattgagacactatccttttgaatttttgacctcatacctactcacttttcaggtctcagctcaaatgttatactcaggaaagacgctccttacctcccaaactaggttagtgtaaatggcactatttatactcctcttccagagcacacaccaaatcttatatttatttgtgggacaatttgaattcatgttgttccccctactcaattgtgagcttcttgaggacatactctgcctcctccttacctagctttattgaagtataattgagaaataaaaactgtatgtattcaaggtatacaacatgatgattttatatgactatattgtgagatgattaccacaatcaaattaattaatacatctagcacaagaaatagttactattgtgtgtgtgttgggggggggggatgaggacacttaagatccagtcttgtagcaaatttcaagtaaacagtaaagtattattaactatagtaaccataatgtacattagatccccagacatcttataactgaaagtttgtgccctttgaccaatgatatggtttggctgtgtccccacccaaatctcaccttgaattgtaatccctgtaattcccatgtgttgtgggagggacccagggggaagtaattgaatcatgggtttgtttccccccatgctgttgtcgtgatagtgaatgagttctcatgagatctgatggttttataagcatctggcatttcccttgctggcactcattctctctcctatcaccctgtgaaaaggtgccttcctccatgattgtaagtttccggaggcctctgaagccatgcggaactgtgagtctattaaacctcttttctttataaattacccggtcttgggtatttcttcatagcagcatgagaacggactaatacagtaaattggtactgcagagagtggggtattgctgtaaatatacctgaaaatgtggaagtgacttggaactgggtaagaggcacaggttggaacagtttggagggctagaagatgacaggaaaatgtgggaaaatttgaaacttcctagagacttgttgaatggttttgaccaaaatgccgatggtgatgtggacgatgaagtccaggctgaggtggtctcagatggagattaggaacttcttgggaactggagcaaaggacactgttgctaagctttagcaaagagactggcagcattttcccctggcctagagatctgtggaaatttgaacttgagagagatgatctgaaattggaactttgttttaaagggaagcagagcatcaaagtttggaaaatctgcagcctaacaatgtgatagaaaagaaaaacccattttctgagaaatacaagctggctgcagaactttgcttaagtaaaggagccaaatgttaagcgccaagacaatggggaagatgtctccagggcatgtcagaggtcttaatggcagcccctcccatcacaagcccagaggcctaaaaggaaaacatggtttcacgggccaggcacagggccgtgctgctttgtggagtctcaggacttcgtgccctgcataccagctgtggctcaaagaagccaaagtacagctcaggctgttgcttcagagggtgcaggccttagtggcttacatgtggtgttgggcctggggttggacagaagtcaagaattgaggtttgcaacctctgcctagaattcagaggatgtatggaaaagcctaggtgtccaggcagaagtttgctgcaggggcagggccctcatggaaaacctctctgctgggacagtgcagaaggaaaatgtggggtcggagctccacacagagtccccactggggcactgcctagtggagctgtgagaagaggaccaccatcatccaaaccccagaatagtcagaaatgctgatagtttgaaccatgcatctagaaaagctgcagatactcagtgctagccatgatagcagctgggagggggctgtaccctgcaaagccacaagggcagagctgcccaaggccatgggagcccacctcttgcatcagcatgacctggatgtgagacatgtagtcaaaggagatcatttgggcagttcaaagtgtaatgactgccctattggatttaagacttgcatgtggcctgtaacccctttattttggccaatttctcccattcggaacaggtgtatttacccaatgcctgtaccccccattgtatcctggaagtaactaacttgttttggattttcaggctcataggcggatgggacttgctttgccttagatgaaactttggacttggacttttgggttaatgttggaatgagttaagactttgggtgactgttgggaaggcattattgtgttttgaaatgtgatgacatgagatttgggaggggccaggagcagaatgatatgttttggctgtgtccccacccaaatctcaccttgaattgtaatctccaaaatccccaggtgtcatgggagggacccagtgagaggtaattgaatcatggaggcagtttcccccatgctattctcatgatagtgggtgatttcacatgagatctgatggttttataagtgtctggcgtttcccctgctggcactcattctccctcctgccaccctgtgaagaggtgccttctgccatgattgtaagtttcctgaggcctccccagccatgcagaatggtgaatcaattaaaactgttttcttcataaattacccagtctcgggtatttcttcatagcagcatgagaacagactaatacaaccaacatcccctcttgtcgattttcattgaatccccattacctgggaatgaatgaggaaggcagaaatagaaatcagcgtattgttcaatatagaaatcctgaagttacacaagataattacgagcaagactcagtacagagaaggaacccttgagctggggatcagagtcttctggaaacaaggagtaccaaaggggagtgaaaaagagaagtggagaatgagtagtagcagtaaaagaggaagtatgtaaagaaatggaaataaagatgaaataaactgtcatcttgttccagagacaaagctagctaggggagctaaggaaatttagagggataaaaagtctcatccaaaccttcataatgagctaagggctagtttttcatagaccctagcccaacttgcaaccctctcactctcttacttttttcctggctctgttttgctttactgcctttcatataatctaaaatgatgttaaatgtatatttcctgtctcttttctatatcacaatataaattccatgaggccattgcctgtgccacatttaccactgtactcccagtgcctagaatggtgcccagatcaagtagactcccagagtgtctgttgtcaaatgattctcagtccagtgatgtttgcactacatggtgctgccacttttttttttttttttacttcattccatttggaatttggatcattttgccaactttagggtttattcctctttatttcccctgtgtttgctgaatatctgactatctatttttctcagctctcttctcctcacactttgcctccaacttcctctctgctacaaattatacttagcacaagactggagccacttttcattgattttgatgtcagtgcttgagtgacaactccatgtggagaactttcaacctcctgctgtctcgttgtttgctttgaaaaaaaaaaatactcatcttcttcctgaacccactgggtaaatttatgctcacaaaaaagacaaaacttctagaacaaaaactgtatgagcttcaaaagtattagttttcccttgattttgagactcaaaagtaccatagaaattttaaaagggggatgaagtaattttgtcattcaacccgatatattttacaatttgaatgtcagaaccatgaaatgtcttttcagtgtactatcatcctcactatttccacctataaaagaaaagcaaaaatattgtttgagaacaaaaaaatattgcagtagcggaaaaattcactttaagtctttttttggaggttgccacatcacgcctgtcttcagctcctctcactgaagattctttgttttcttgaaaccagttggtcacttccaattcttaccacctataaatcttcctggttctttatatttcactttatatgtcccttatctcctctgatttttgttccagtctttcattttttacattctttgtcatcctatatgtcagaaagaatctgccactccaaattccttaatatatttatctaccagtgtttatttgcctgtcacatgtactcttcagtaatccattgacttgaaaactttctactctgtctttcttactatagtttgcttcttgagttcaaattattaatatattaggtcaagtaattctatttttatgcacattttacctaacattcttggtaaatataattgttttttaaattgcatcacatggtgagtattaatttaagacgtaattagtattaatctactggacaagattttatttattaactgttttgccctttgctagggttctgtaatctcaccctcagtgcctttaaatagtcttacccaaggatcacctatccctcttcaatttaaattctctattgtgttagtttctgagattgcacattctctggtttggtttggtttttcagtgatctctgtggtcacttccaaccatttctacttagtttacttttttccctgttagccctcttcagtgttaatatcacctggaagttaacccattcctagtctgcattgctctatggccagcatcttggctgattggccatcacctatcctgtacttattgtcaatttttttaaattttttattgtggcaaacagcacataacggaaaatttaccatctgtctttgttcatgtatgttgctataaaggaatgccagagactgggcaatttataaagaatggaaggtttatttggctcatggttctgcaggctgtacaaaaaagcatggcaccactaccaacttctcatgagggcctcaggcttcttccattcatggtgaagggcaaaggggagctggtgtgtagagatcacatggttagagagcataaacaagagagagaggggaagtgccaggctgttatttggcaactagctcttgcagaacctaacagaatgagcagtcactcaacctgcccccaggaagggcattaagccattcaagaaggatccacccccatgaccccacacttcccgttaagccccacctccaatattgaggatcaaatttcaacatgagatttggaggggacaacatctgaactatagcattatcttaattcaaataattttactaccaattccatttattagagaatctaagattaagactactgaaactatgccaatgattatctctagttcaggcttctctcttcaattccaaactcatattttcacctgctgacaagctaccacgtagatgttccacaggtatttctaactcaggatatgtaaaattgatgttatcattattttctgaaaatctattcctcttactatattccctatttttgtgaatgacacaatctaatggactggccatgttaaaaatcaggaagtttttctggcactttctttattccttaatattaagccccacgataaattaccaatcctttcgatcttgttaagacaaataagcttgaaatttcttatctcttatttagcactgcaattttgttttctcattcattcagatagcatcttctacaaaacctcttcactagtttttctgtctctcagctcatcttgtacactgcaaatccattaaaactacactttttaacatgccaatcataatgtattagtaaaggttgtataatagttctctttctcttctaggataaaagctaaatttttcagcttggtacacaaggccgttcatggatttggtacctactagtctatctagggtatttcctacatcttccctcctctctcttgaaaaatcaagtaatactaaactatttgtaactccctaatcaccaattgctgcctttatactttaacatatattcttccttttgctagaaatacatttgtcataataggctctttggtaaacttaccattacattctcagtttataatattatttgtgtaagtaccttttttcctacttagtcctccaggggaatgcatgtgcttctctctccatattatcattttaaaatttactcctatttcagcaagtatcataatattttactgagattaattgttggcatatttatgttaccctggtgacatatttaatagttaagatgctttgggctgcaagaaagagaatgcactttcaaagtggcttcaaaaataagaataattcaactcacataactggaagttcagaggttaaagctggctccagatgaagtacaagcagagctctgtcactctttctctatgactttctttgtcctgatttttttctctgcgtcagctttgacctcctcactagttgccctccaggttccaagatgactgccagcaacaaatgggtaacataatttcttgttacagtgagagacataaacacttacctcacagattcagagatttcaccctcagataagaacaatcaaaattttaattgtgtatctactgtatcattagtatatgtattaggtattcatatatatctactattgtactaaagatgattcagaatggtttcataagctggttgatttaaacttttcttcctgaaccaagaggatgagattatcttgactggcttagaatcgaagatttaggtgaatctaaatccatctccagaactgaggatggattccgtagaaacttgaagacaattggaattctcctagaaagcagaatttcagagtgggtgtagggatatctttgaatggaagttgtttaagccaccaacaatattcactccattggggtgacactgggcccaaaggtacccagttaatatttgttcaacgaacctataggaagacaatattatctgcaagctatttataaactaaatgacaacgagaagtatttttagaaaagttaatcatatacaatttagtcattcacattgggaggctcttcctaaatttcgtttctgatccttatcttgatctttgacgcaatcatatcttggcctccatctaaaagccagtagaagcctctggccattttttaaacaattggtttaacaacattaattggaatctatatagctcaacttaaaaaaaaaaaaaagaggaactagcttatcataatacaatattgtcaaggcaagtgatacttccatgcagctattcagcatttggtgtattcttggtttctgcagacctaataaaaagagattatctcagcgtcctctaggtttaattttaaaaaacaagaaaccatgaacaatgaaaatgatttcaaaacatcttcactcacatctaaaatatgaaatagctagatcagaggttcttaataatttaatcggtgaagcataactgaaggatttagaaaaagtgcctaaactattaaaagattcttcagctgctgcttaatgttgatatcaagttattttttacactggcaaacagctaagccattccctggtcacatccacttttcagcatttagcgctcctctcaatcatcccgatcacagccccaggaatgtttcatggcatctccgcaataatagtatattactattgggtcctgaattttgaggtagtttatctttcagaaaggatatgaatagagcaataagtccaagtagagtgggctttattaatgatgcccaagattttagacgtatactataatcttcaatcaattttaacaccacttcccttaccctagttttagtctaaaccagtccaactgtgctgtagtctcagataatacaatgttagattttttttttcaagatatagaattgtcgggaaaacttgtatgtaacctataccaatctaaatttcttagcatttaactctaaagagtaaagcttttagcacttcctgtgtaatacaagggcaagtgctgatttctctgaatataattttcctttgttagcacatatgttcactgtttaataaaaataagaatgcttcaattatctccttttgtcaagggcctgagaaataaagaaatatacagagggtcccaatctaaaaatgttttgatttacaatggttcggcttaggatatttttattttacaatggtgtgaaagtaatatgcactcagtagaaatcatacttcaagtactcatacaactgttctgcttttcatgttcaatacagtattcaataaattacatgagatgttcaacacctttaataaaataggctttgtgttagatgattttgcccaactgtaggctaatgtaagtgttctgaccatgttgaaggtaggctaggctaagcaatgatgttcagtaggttaggtttattaaatgcatttttcaatttatgatgttttcaacttatgatgggtttttcaatttatgatgttttcaacgtatgatgggtttatcaggaaataatcccattgtacgttgaggagcacctgtatcaatataggcatttacacaactctcgtactgatagcggcaggaggcagagaagctctaggcagaaaagggatggtccccagcgaaaaccccaccctcaagccaaaaagcctgaaaccgcagctcaaagtgggaacttatatcccagttttcctgctcgaatgttgcctttttctaaaccacccatggccccaccccaccccatcctgtgcctataaaaaccccagactcagctggtagacaggactacagctggacatcagagagaagcagcttgacttcagagggacaacttgatggcataactttagagaagaatccggctggacttcaggggaagattacttgccacccccatccccttttcagctccccttcccactgagagccactttcatcggcagtacaatccctcacatttacaatccttcaatttgttcatgtgacctcattttccctagatgctggacaagagctcaggagccacaagtgtgaatacaaaaggccctttgcccttgctggtggagggcagctgcctcctgtgaaaagacaaatggcccactgagctgttaacgcctaagctgtccgtggatggcagagctaacagagcactgtaacacaccctctggggcttcaggggtcgcagacgcctccacctagatgctgctccagtgctcatgcactccagttcccacctcgtttgcttgcacactccctccagtgaggagttgagagcagtgggctaagtaaataaggcacccctgttgcgagttccacaaaggggtcagggaaatatcctgcttcgttactaagtaggtataaaccctttactaagttagtaattattcagtaataatacttaaatgaaagctattctgttagactaaattcagattatcaaagacacgacagaaaacagctttctcattcatgaacctattatttccttttgtaaaatatgttaaatgaaaatacagccgtcatgctaatttctaatggtagaacatattttgaaaactcctttatgtttggaagattttgctttagtgcagataatcagaatgatgtgatatactaagaaataatttttaaaatgagatgtgacatttctcataatctaaataagaaatggcaaaacattgtcctaagctaaataactcatatgaagtgataaaatattgctttctaaaggtccatgatatgtagtgatttctaatgtgtttaatagcattgatcctattgggtaattgggtggttctaacatgtaaggaaggcctccagtactaatttcatgtactgggaaactactgggcagggatgaatcccttaactcctaagtaagactatcagatcatataaatctgctttttgatttgcaaagactcttaggcatacctcttgagaatattaaacatctactaaattatatgtaaagcatttcagtctaagatttacaatgctcaaaggagaaagattttaaagttcagcattggaatttccataatttccttccaattgtagaattttacaattgagatagcaaataataatataaataaatatgtaagactgaaatcaacataggagtttggaaagaagactgtatgggttaactagagttgtcaacaaagacttcacagaagattgtgatcgtagacattagtaaggaataaaatgggtgcaaaaaaaagtctaagaaacaacaaggataaatttattttgtaaagagtgaaagcatattgggtattacataaagagactggctagtttgacacaatgtgtacttttggggtaagcagtgggaaatcactttctgtaagtaaagtggaagagaattcaggtattggatatggtcatataggatttttcaacctttgttttgcccccatccctatcctaccagtatcatcacagatgttggcaatattcactcacttgcctgaagatagatattcatgtcaggggctacagatatgtaaaggtgaatgaagttaaatagcaaaattcaagcacactagttctgactgtgcaccctctctcactcagaaaagcactttggaatgcgagagtactcttatattgacaacctttagttggttctaatttataaaaaaatataaaaatatttagacaatttggatattttatatctatgccacaacccattgtcaaatgattgagatatcattgtttggcaacaatgaaactgaaatcaactctaagagtaaagagtacgacttttaaagatatttggttaagagtaatgttgcaaggcagagaccaacattatagaagttctcaacctgtgtgctggatatagctaaaatttcccaggaccattgaaagaaattctcaaatccacaaccacctcaagtgttgtctgtgaatcaaaggagtgatgcattacccacaaacatgtagtagacattttttaagtgatgtagatgctactgcaattaataaatgcaaaattatattacaatattactgaattcagaataagttgattttgtcactatttttctcaatctacgcatgctagatataaagttattatatagagacgtaacatttttaatatttcagaagcatgctcatgatattgtaaaccaggcactgttaaaagatcactggattgggaattaataaacctgggatctagtcctcatttgatctcttgttggctatggtttgggggttttgggcaaactattcaaccttttctgccttggtttaattgataaatgatggtgttttcccagataaatcccttcccaacttaatattaccagatgtagcatctatggtttagaatgtacagtataaattaaccttcctgaagatcttcacaagttactataacctatattttcatggcactgaaaactaagtttttgatagcttacgtttttataaataatttacttactcatttttatcataataataaatctgattcactaatcaccaaaatatcatttttgaaaatagatgcatgaaaggatccgaacttgttatggttttatctgttcaagtcacctaattttggtagccacaggcccccattgtcaataggggaagattatccattttagcaatacagtctctgataacttcagcccatatgcccttcaattccacttttacgtcagattgaatgggaatgtgaggcccccagtagtaaactaaccctactttctctttggaaattggtctttctacctagctctttgcctctgttcacgttcttgtattccacagaaaatatatacattaggtgttaaaatcacaatgattaacaatttttaagtagaaatagttattaagtatagcataatcatgcctttgaattagtacaaaagtaggaaacagagctttagtgacttttttcattctttccaccatttacagggcaaaaatgaagaattttaccaattcaaaactatgcacatgtatagtttccaccagtatttagtagttatgtttctcaagatgtataattcctttcctttctgttttctgtagtttgataaaccctagataggagttaatgttgtttcagttaggtttattatttcttttatgtggtttaatttcatgcaataagctagagattttgtaacataacttgataaaaattttctcccttcgtatctttttgttttaaaataatggattaatatagattgtaattttacagtagaggaaatacattttacttttagttcttatctagatatcttaggaaaaaagaaacatcatttttaaggattattatttttctactaatgaaaaaaatagcatgattttccattctggactttgtaattaactttaccttggaataattgaatcttaaatataacttcattgaaaattttattttcaagtaacattttaaaatgcaaaatttgtgtgatctctactaaaaagaactctcacatcccaatgtgcttatagctacaataattggttaaaagagacaaattataaagaagatataggttgtgacattgaaattacaaaatgtggattagggaagtaagcgtgtagagttttgtatgcaatcaaagttaagttattaccagcttaaaaaacccttacgtaagatgtaaagaaaagcaaaaacctatagtagcaaaagcaaaaacctatagtagatatacaaaaggtaaaaagtaaggaatcaaagtatactactgagcaaaacagtcaaaccataaaagaagacaacaaaaaaaggcatatagaacaaaggatctacaaaacaattagaaaacaactttttaaatggcagtagtaaattcctacctatcaatatttactttgaatgtaaatggattaaattcaccagtctaaagatagagtggccaaatggattaaaacaacaagactcaactacatgctgcccataagagactcacgtcatcttttaggacacatgttgactgaaatagaagagatagaaaaagatattttggtttccatgcaaatggaaaccaaaagagaatggggatagccatacttctattagacaaaataggctttaaaaatcaaaaactaaaaagacacaaagaaggtcattaaataatgataaaaggatcaattcatcaagaaggtataacaattgtaaatatatatgcacccaacattggagtacctaaatatataaagcaaatataaagtgataaaaagaaagagacaaactacagtacaataatagtaggggacttctaccccaaattcaacaatagacagaaaatccacattaaaaaatcaataagaatgcattggactttatgctttagatcaaatagacctagcagacatatacagtacatctcatctaacagcaggagaatatacattcttatcaagtgcacaagaaacaattcttcagggtagatcatatgttaggccacaaaatgagtcctaacaaatttaacaagattgaaagcatgtattttatgtaaaacaacgccatcatggaaaaagtactagtgtaaacaaggtttaaatatgatttactgattgtttaaaaaggaattatcttagccctgatctgatgggatttcccctttgtaagcagcaaaaataagttcataatgaagcaactgtaataatacagcttcacagatctttctgaataaacagagttggatatgtttctacttcagaaaccatttactgtgggctcacagcttttccatacactctttacactcttaattttaaacccattcatcaaaaggattaagacaatgagattcaagtccaagacaataggaagtatgtgcatcaaaactgtcatgctaatgctctgaggaacattgttatttcaatagcataatttaaaaccactgaaaccatgttttatttatgattacctttcatacgttcaaaaagaatttgagatggtttggcagggatgtcttaaagaaacaaacaccaaatttttatttgttgtgcttctaacaagcaatttttcctacgtaagtgttacctgttttctccccttgattttgatctcttttgtatggttggtagttgtcgcacttctgggcatagtatggttttctacaagttaaataaaaacataaattgattttgatgtagctagttccactatttcagttagtgtgttttccatacctgcaattcataacatgtttactgacccagaacgttaaaactcaagtttagttcaatacagtcacttcaaaccaacttaagatagcagttacatttccaaggtcattatgaagacggagttcaagacttcagcagttgaatttgtcaagctcatgggtcttttagttacaggaagtgtgcatatttcacataagaaacagcaactctgatgatacattgaaactcaaatatacccaaggagtgtaaaactactttataagcccttaaacaataaatatgccaacaatcctctgcatactttttgtcattttttagagcattcaattgaattatataacatgtgataccaataaataattaactttttatttatttatttagagaatgattcttgctttgtctcccaggctggagtgcaatggcatgatctcagctcactgcaacctccacctcttagtttcaagtgattctcctgcctcagcctcccaagtagctgggattacagccatgcaccaccacgcctggctaattttgtacttttagtagagacagggtttcaccataatgatcaggctggccttgaactccggacctcaggtgttctaccacctcagcctcccaaagtgctggtattacaggcatgagccacagcgcctggcttataattaactttaaaaaatattctactatcgaatgcctgaaaaaatcatattacttctatgtattaaaaacaaactattacgtaaatagaccagagatacggtgtcagagatgagattccttggcaacagtctctgagacaaaaagttgcacacagaaagtattttgagaagtattgttgctatttataaggaagtgaaggaggcagtattgggcagagagaaaagctcatccacactgcagttgctactgaggcttcagcccatgtgacagggacactggagctgggatggtctttcagagttctaccaaattgaggcaaatgggcgagacttttgtatctttgcactagccaagagcaggcaccagggagaaatgcagctgtgatccttttgtagatattattattctggagtcaatgcaaccacaccacaaatactaggaataatattggtagtgtgggtgcatcgactccagaagaggatcttgatgaagcattacagtatccactacagagaggcactggcatattctgcttaccccacaaatattgcaatgaggatgcaagtaggagtagtgaggacataaaataaatcgattattttccactgggccttaatatatcagaaccattggaatttacaggatgatatttattatagtactcaaaaaaatctcttttaaatctccttaactcagaagggaattttaaaaagtccacaattcacctggtctatgaattcccttttaaaataaaatgtggtttaatcaaatttacaagaaaaaaacaaacaaccccatcaaaaagtgggggaaggatataaacagactcttctcaaaagaagacatttatgtggccaaaagacacatgaaaaaaagctcatcatcactggtcattagagaaatgcaaatcaaaaccgcaatgagataccatctcacatcagttagaaaggcgatcattaaaaagtcaggaaacaacagatgctggagaggatgtggagaaataggaacgcttttacactgttggtgggagtgtgaattacttcaaccattgtggaagaccgtgtggcgattcctcaaggatctacaaccagaaataccatttaactcagccatcccattactgggtatatacccaaaggattataaatcattctactgtaaagacacatgcacacgtacgtttgttgcagcactgtttacaatagcaaagacttggaaccaacccaaatgtccatcaataatagactggatacagaaaatgtggcacatatacaccatagaatactatgcagccataaaaaaggatgcgttcgtgtcctttgtaaggacatggatgaagctggaaaccatcattctcagcaaactaacacaggaacagaaaaccaaacaccgcatgttctcactcataagtgggagttgaacgatgagaacacatggagatgggggaggggaacatcacacaccagttgggggattggggggcagagggagggataacgttaggagaaatacctaatgtagatgaagggttgatgggtacagcaaaccaccatggcacgtgtatacctacgtagcaaacctgtacattctgcacatgtatcccagaacttaaagtataatttaaaaaatgtggttgaaaaacaaaacccacataatacaaactttgccagcttaactgttttatgtgtacaaaccagtagtgttaactatacatacattgttattcaacagatctctagaatgttttcatctctcaaatccgaaactccaaacccactgaagagctcccattgctccctgtaccccagcactggcaatatgaccactctactttctgtctctaaagagtttaactactttagatacatcatataaaaggaagcatgcagtatttgtcattttatgactggcttatttcacttagcataatgtcttcaaggtacacccatgttgtagcataggaaaggatttccttctttttttgtggccgagtaataatattccgttgtgtcctataccacattttttaatccgtttatcaatcaatggacattttagttacttcaatttttggctattgtgaattatgccgcagttaatatgagtgtgcaaatatctctttaagatcctgtttttaattcttttggatatacagatgctcattgatttacactgggattacatcccaatcagcccatcataagttgaaaatatcatgtcaaaaattaatttaatatgcctaagctaccaaacatcattgcttagtctagcatactttaaatgttatcagaacatgtagattacagtacatctgggcaaaatcatcttgcaacacagtacatagtagagtatcaattatttatcctcatgataaatatcatgctgcaacccaatatgtcagaagagagtatcatactgcatatttactagccctagaaaagatcaaaattcaaaatttgaagtatggtttcttaatgaatgcatatcgctttcacaccattgtaaagtccaaaaattacaagttagaccttagtaagttggggactaaccgtacacccagaaatgggattgctggattatatgataattctatttttattttttgaggactggattatatgataattctatttttatgttttgaggaacttccatacggttttccatagtggctacaccttttcacattcccaccaacaatgcagaagtgtttcagtttctccacatccttgccagcacatgttattttctgtttatgatcgtggtcatcctcatggttgtgaggtaatatctcattgtggttttcgttcttcatttgcatttccccgatgattgacgatgttgagtatgttttcagatgcttgttggctgtgtatatattttctttggagaaatgtctatttaaatccttgcccattttaaaatcaggttaattgtttttggtgaattccttattaattactcacctcagagcctttcttcttaaaatacagatttctcagaacctttcatctaatttactaaatgttgatcttgaagaagtattttaatttatctgaatttagtttcccgttctataaattgatagtaatcatgttttccctatccacaccagagtggtatgatgaggaaccaatgcagaaaatgactaaaaaggcatttttatgctgtccagatcttgtgcaaatatattataattgatttgaaccaaaagaatctacattttaagactatttaatattgtcgcatttacattgcactaatggttcctcttttttctcactgatgaagttctagattgaaactctgaggaaactgtaaatcacagttacataactctgttatattaatttatataacttctctgtctctctctaaatatatatatttagactatatatacatatgcatatatatatttagagagagaacgagattacacttaaggactctgcttagtacattgcaacttgcacctcattctaattgtgaaaacaacaacaaattttgattgagaccctgttatttttcagacctttggtcttgtgaggaaggaaaagatgattctgatacttatctcaaatagcttatcatctcctctggtggatgaggcttgtgagggcctgacacatggtagaggatcttattcattatataacaactttcaaaacacatcactaattatttttctgcttaaggtgaaaacgtagctctcccaaacaaataagagatttagactgaattctgtagaaaacactgcttacctcattttgcttagttttcactgcagagtcttgtctctaacattcaggtaggaggaactctattttaaaaaattgaataaacaaacccaaatcagaataaattatttaattcaggagttttttaaggtgctcagaattttggtagaatagcagtgtattttctgtaataagaactacacaatgttctctagctggttatactcaaatggttatatggattttattctgatatcagttttgcaattgatgaccacccttcatcaatagcgtggtctttattatggtttcatctggctttttcttcccttgtcttctgcactgggctgcctacttcttggctcttattattacatactctacttttttcatatacaaaggtcttagtgcattaatagtgagtttctgctaaaagtgttactttcttcaaatatcctgtcaaatgctggctgcctgatttattgacctcatagagtgactatgtgaatcttccattctctgtggaattccattccacattttaacttaaagactccgtcttttccagctgtgttctctctgctggataagcatttttcttttaatttctgtggtaatgggaagggaattttaaatcctgttttgcgtacaagtgtttaacaggtaaaaatggatgctgtgtcagctatctattgctgtgtaacaagctaccccaaatgtagagacttaaaataagaatcattttttttttttagctcatgattcttgattctgcttggggcttggttcatcgaggcgattcttttgctagactcagctgtgctcattcatgcactcgtggtcagctggtagttgatgaccacatgtggcattcatatgtctggtataactttttggttataagttgagacggtgtgggtgacaggatcacttgcctgtaattattcatcaggctagcatagttccatagcggtggaagagttccaagcatagcccaacacccaagcattgttaagcctctgcttatgtcatgtttgctgatacctcattagccgaaacaagtgacttgaccaatccatattcaaggagtggagaaacagactatggctcttaatgggagaatctggaatatctcttgacaaaagtgtagatgcaagaggagaatctgtggacatttactctccagcagagatgttgtcatttttgtcactaagacagttcctgtgtaatattatttattattccttggcagccataagtttgtggtttacttatggatacttcagtgcctgcccaatatcatgttggaaagagaagcccttaacaatttctcttaatttctacttctgaggaatgagaaaaaaaaaattggataggcataaatgatttccagcacaaattctaagcagctatttgagaggtgggtgggtagggagagatggaaaatccttttaattgagacatgctcaaccataagcaatttttctttcctcaggagacatttggtaatgtcaggagacatttttggttgtacatctaggagggagctctggccagagatactgacaagcaattctgatcctacaatgcacaggacagccactcacgacaaaaaattatctgggacaaaaatgtcaatagtgctgagattgagaaaccctgcttttcactgagcgcatgtagatgaattcatataatgttagttatagaagggcacttagatgatgccaactaaaacaggaaaaggcaatgattatttctctattcaagttagtgaaggaaggatatgtttaaagtcaggttggagatatttctcaagggtaatatttaagttgtgagtggatgccagatgcgcttgattgttacaatccatatttttatagctatatcaaatgatcttctctcccaaattaaaatggatattagatatatttcatggataccatatattataagctatagctcttagaagtatttgagtgattaataattcttgcatattgaatgagacatgtaagaaagatacctgatgtcctatgattcttagaaatatgtgcagtggttaagcacattgtcttggaaacatcacttgttaatgtgagatcctgaacaagtttcgttaccttggtaaaagggggatgataacatctaccctgaagatggtttggtaaaggtgaaataaaagagggtttatgaagaaccttgcctagcacataagaatcactgagtaaatgatgggggtgatggcagtgttggtggcaattatcttacttgtaagtagtagcaaatatttatttggattatatttttaatagcaagaaagaatctattaaaatgtaagcaaatagcaccattaagctttaaaaatccatagctcccaaacttaacatttttttttcttaaatccagaaatacaaatggttatcatgaatccttgagttccagtactccggccttgcctatgtagagtacaagcatttatttttctaaaatgagaattattgatgttaggtgtgtcatatattttatttactctttagagtgacagaaaagaaagcagacaaaaataagtgtttatgtgttcatagtgtttgtttctaattttccaacttgtatgtgcagactgtaaatatttagagggaagacatgaaattcttccttacctacacaatagattgtctttcttagaatctagacatgatttcaaattttcttcagaagttctcttgaattcttacggaattcattaatccaaatgccatcctttcaaatattcaaaaagaaaatattctccaatgttgcttacatggaggagagttattttatctactagtgagatggaagtcgctaacaatctttcttataccccatagtattaaatagtaatgcaatttgatcacatataacattgctctcctgttgacatggaatgataaggaggaagggaatatctaacagcactttttagatattctctcatagaattgttaatgtgagcccaataacttattttgtaagttgagtgatttttcaaatataaaagtgaagcaaacaaaaaaagttacccacattcattcaacaaagctagaaatagagtatgtgcttcttgctttcttatcaaccaaaggagacctgtgaattacaggaaaaccatgtgtgaatacttcaaaggaaatatgccaaacacattgtgtgtgtgttttaaaagatttagtagctcctttaaagctctaagtaaagctgttagtctgactaatcatgtacccctgaaaccaattaaattttcagactagagaagtgttcttcaaacacttgaaaaaaataagagttccttcctaaagccaacaccttttaattaacaaaatactcagagcaaagctgtggtttgcaatagtatattacacctactgttattcatgctaccattctggtgtgccaaactcaattcatttcaactattttgagcttgattttctgtctgcttaactatggagggaaaaccacaattttagtagagtcattttaattttctaatgaatgcatgagaaaggtattatgctacatagtatgtcctcagactattcagatgccctctctctctcttgctctgtctctgtctgtctctctttacacacacacacacacacacacacacacacacaatgtgtgtatctatctgtctacctagatatacagtttaattttgtacattgtaatacatctggttctggcataaggtgattgagcaaaaaacaaacaaacaaaacccacccaaatctgttactggaggaacctttaatagcataacatcagaaagactattttcagtaaggaccctaggcaggaaaagacaattcctccaatggacttgagaagaatacccttagtctctgaggtggttagagaggctgagatctgaaccagctaataccagagccagcttcttgtaacccaagataggggcataagaaacggggtgaatgcccaggcatgaacagacttggggttaagattaaatagggtacacgggaaaggatttccgccagctggaggggaagccatttcccatgctccttagggatgacaacaggagacccagcccagaacatcattgaaaattctatgtaataatttatatatcctaactctttacccgttcgttctagattatggattcaggcactcttagcaaaacaaatcctctttcagtcttttaaaatattgacttaacaggaaatatccttggcacaacaatacgaccctgcctgacccttagaactgtgaacaggttgctcagactgtacaaaaccactaacaaatctgaccagcctacacttcactgaaaaaggtgatttgcatatatttctagtactatgacatggtggaaaagaaagaaccgcatatgtgttagataaaggtaaacgcatctgaaagtgcagtaagaatcaatgtgatatatacaataaaataagataaataggccgggcatggtggctcatgcctgtaatcccagcactttgggaggccgaggcaggcagatcacgaggtcaggagatcgagaccatcctggccaacatggtgaaaccccgtctccactaaagtacaaaaaattagttgggcatggtggcaaatgcctgtagtcccagatactcaggaggctgaggcaggggaatcgcttgaacccgcgaggcagagattgcagtgagctgagatcacgccactgcactccagcctggcaacagagcaacactctgtctcaaaaaaaaaaaaaaaaaaaaaaaatttcaggacttcaaaacttctgtcctttgaaacactttgattaaaaaatgaaaaaaatatatacatgcctgaatccagaggcaagtctttttagaaaacataaaatattttaagtaatgtttttctgaacagaaatggctctaatgtgagaggtcgatgaagattagcctcttgcttctttatgttttaaagtatattccttgagacccaaagtttctgactttagaatccaactctcaactactatcagctatcctctagacactttcaaaatcctccaaaacctaatagtggtgcaagattttgtccttcctagtgataactagatttaagtaagaaaacgttaaagactaaaaagtgtttaggacccacaagaaaggtgtaattctgttcctcatggagatattttagttacacacttcttattctggtcctccccaaaacacagaaatctagagttgacatttaaagagaaaatgagatttttgtctggaaacaggagagaaaaagttttcaagaagtatagaaagcgtatgaaaggacacaggtttgaaatggcctgtgctcatgagagaatgcacaatagacatgggtgtggaggagcctggaaagaatggagagaggtaagtctggagggtcaaatctggttcagagtacagagcataaaatcccatacgaatgtagaacatgaggagccaataaccattgtgtgagaaatgcaggaaaaagaggaagaaaaaaatccacatagtgtacttacagtcagaacaatcctaggaggtgacttacatgtatgatgtcataaaatccgtaacacaattccattagattggtactgttttcatagttacacaggtgaaaacttttgagggtcaagatgttcattgtagcaggcatagtataattccttacctcaagatgcctccaatgtcagtgaacattacttttccaagattgtctatttaggaaaaagtaaggccagttgtctatgaaggaagtactattataatcgccactttacagaggagtaaatggagattcagagaggttaagtcatctgactatagttacacagctaaaaaaaaaaaaaattatagagcaaggattcaaatacaacaatctggtcctagaaagcctaaatattctacaccctgctttctgattcagagctatttcctgcttttctcccttcgataggaaaaaaaatgtatgtgtgtggggttgggggcaaataaattgactggctgtattttctctctttaatatttgatctttcattgtctgctccaagcagtgggtcttcctccattatcttctcgtgaaaatagctaaaatcacctaactagtaaaaacctaggcatgttttgtgttctagcctccattcttccattctaatgggtggctgttaaattttagtactcattgtatgtagaagacctctaagttcactaaagagcttactgcacattgacttttctttagattcaaagggaatcaattgagcacctcctatactccaggacatgtgcaagatgcaagagatagagcagtgagaaagtctgataaggtttcccctccctttcccagcagtgtacagatagatgttcttcaggtggtgcatgctggagaagagaagaccagaaatactggcctgacgggtctatagatgagattatctgcccatgactggcgcagggatggccgcattgctagacctctccatcatcctctgaatatgcttcagctaatttatcatcccaatggcatatttagtcatcatgaaccattctctctttttgagtctcaggccctggccttgcttttcaatagacttccaatagattccttcctccttccttcccttactgcctggcttcctgacttccttccttcctgccttcctgccttgtcttgccttgcttttcaatagattccctccctccctccctccctccttcctccctccctccctccctgactttcttctttccttcttcctttctgtctttttccaaacgtgcttttcaggaaacagtggtctgcttgttgaagtctgataattctctagttcctcatccttcactttattgaaatttagtgtgacatgatcatttccacctcattaggtacttctttcatggtcagaagtaagtctggagaaaaaaaaaaaatctcttgtctctgctcttatttgagggtcaaattttcaataagtcactttttaaaaaagcattttctgacacttcccataagcttgaaatcctcctaaattgctgtatattgcctcagtataccttgtgtatctattttaggaacactccatccacatttgccagtcagcctggtgttctgcagttagttcctacagtgatattttaatttagctctcttttcatcctcacacatgcatcctctctggatatttagctcctttcctggaatcccttttaagatttctagatctttttgcttccatgatttcttctcctggactgtgacacaaaatgctatttcttctttacattacatttaattctttctagaaagagcctcagagtagtcagatagctttgagaaacaaaactttttctttattgcctcactgttactgcctttcaatcattgtttcgtgacacaaatttttttattctctctgacaattaaaacactatttttttctgtctgcattgatcaaaattagttccttcattcatagaaaactcttggtgtccctgagaagcttgagagacaagaaacattcttccattctactcatcttcttctctaatgaggagacaaccttaaaagcacagttacatagccataaaaattaatgattggctacctcagaatgaaaattcaatgtctcatttttttttaatattcttagaatcgttcactggttgtccagtgtgagtctcctgttgagatgtcttttgcagctttccttgaaacctttcattccaaactacatagtccaataattttgccaccaatcttctggttatattatgctcttgagtctgttgtctataaacttgattaggcattccttcccctcaccactcacctctgataacccagctgtgtgttggtatttagtatcaattcacaccagcaagttcagccctcttcaatcaatatagggccacacacggacttttgactgactactccccaagtatttcacattttggggccttatctccagtttctcaccacagttgttcatcactgtgtttcttactagccaggcgtttataaaaacagtaatacctaacactattgatcacctactatagtgtcaggcgctgtaataatattattgtgatgatgatgattatgctgctctttctggcattgtcatacgtgtattgcttgtactactcactgaatctacacaactgcccttatgacatttaccctgttattattcctcttttaaggtaaatacatgaaaaatgcttcccactttgccttgcttactgcttattgctagtactgaacaaatgttagaactgaaacttagagaggttatgtggctttaccaaggtcccagagttcctagggcagagaacaggattgtctaccagacattttaattctagtactatgcatcttaaccattaccataggctgacttactctacagtgtccaacactattcatattaagatttatttaatgactttgaaacagtatttcatgtctaaatagaaaaactactaactcgcatttttaagaaaatattgtatcttggtttttcttcactgctggccagtttactaacaatctgaaataaaaagaaaaaaatatgataaactgctcccagtataaaatacagagctaagacaagaacgtttcattggctttgatttccctagggtccagcttcaaattaatttacttcctattcaagggaattttaaatcagaaagaagatcttatcccatcttgttttgcctttgttttttcttgaataaaaaaaaaataagtaaaatttatttccctggcaaggtctgaaaacttttgttttctttaccacttccacaatgtatatgattgttactgagaaggcttatttaacttaagttacttgtccaggcatgagaatgagcaaaatcgttttttaaaaaattgttaaatgtatattaatgaaaaggttgaatcttttcattttctaccatgtattgctaaacaaagtatccacattgttagaaaaagatatataatgtcatgaataagagtttggctcaaattgttactcttcaattaaatttgacttattgttattgaaattggctctttagcttgtgtttctaatttttctttttcttcttttttcctttttgcaaaaacccaaaatattttagctcctactcagactgttactctggtgacacaacctgtggttactaaggaaactgccatctccaaactagaaatgccatcttccttgatgttggaggtacctgctctggcagatttcaaccgggcttggacagaacttaccgactggctttctctgcttgatcaagttataaaatcacagagggtgatggtgggtgaccttgaggatatcaacgagatgatcatcaagcagaaggtatgagaaaaaatgataaaagttggcagaagtttttctttaaaatgaagattttccaccaatcactttactctcctagaccatttcccaccagttcttaggcaactgtttctctctcagcaaacacattactctcactattcagcctaagtataatcaaggatataaattaatgcaaataacaaaagtagccatacattaaaaaggaaatatacaaaaaaaaaaaaaaaaaaaagcagaaaccttacaagaatagttgtctcagttaaatttactaaacaacctggtattttaaaaatctattttataccaaataagtcactcaactgagctatttacatttaaactgtttgttttggcactacgcagcccaacatattgcagaatcaaatataatagtctgggaattgattattatccactcttctaagttgtctgtgccaatttgccttctccaatgataaggataattgaaagagagctataacttaaaaagagaaaagtaacaaaacataagatatttaaaattaccctagatcttaaagttggcatttatgcaatgccatgttcaaatgaacatgtttttaatacaaatagtgcatttttcagcctcagtgtaatccatttggtaaaattatgacatcaactagaaacattagaatacattgatgtaaatatggtttacctagctagatcaaatatactatatatcttttatatttgtgaatgattaagaaaaataatgttggaattgttatacattaaagttttttcacttgtaacagctttcaagcctttctaaagaaatacaaagttgtgctgaaggtatttaggtattaaagtactaccttttgaaaaaacaagaagtgaggcagacagagtaaggggaatttctttgtaaaataaacttcaccaattccataggaataaaagtaatttgatagtaaacaacctgcatttaaaggccttgagcttgaatacagaagacctgaattcagtgccatttgcaaatgatgattgtggtcaagccatctctggatcttcgtttcctattctgagtacagagcatacagagtacacattcacattcacaatatagttatggatatggatgtatataaatatatgtaaatactacatatatgtacctaaaatttgttttacttctgctttaaaaaaagtaattatagccacatttttcagaaaaagtaactgaggctcatagatgtcaaattcccagtaagtagcagaacaaggattcaaatccaagtccatttgattcctaagcttgtgttattacttgctactgcagagagtatacgtagcaagtaatatatgtactgcaagcaatacatactattgctgcggtaataactgtaactgcagttactatttagtgatttgtatgtagatgtagatgtagtctatgtcagacactatgctgagcattttatggttgctatgtactgatacatacagaaacaagaggtacgttcttttacaataccatattgagttatataatactcccaggacttttatttaccaaaggaaacaatattttataatgtttaaagcccaggttttgaagttacattgtctgggttcaaagcttggctcccaagctgtgtgaccttgagtaagttattctgcctacctgagcccaagtttatctagctataaaatggggatagttgtactatctgccttgcagtttgtcatcaggattaagttggttggtacatgaaaaatgcttcccactttgccttgcttactgcttactgctagtattgaacaaatgttagtaattatatttggttccaccacgaactctagaaatctaaccaatgatggcatttgtattatgcaaactgtatatcacatcataatattatatggaaatgagagcttgtttccgcttctgtagcctagtctaccattgacatagcttcctgcagaagttaccagataatagattgggagagaaagtccacacttccttgtgacgggtttgtgagtccagcatttagggaagccattgatgtgctcagtagtctccagagttctctaaataaatgtgtccttttcagaaaggactactgatttgatgccccctcacagagatcgtctttaaatataggtcaaaaactaatgtagagggccaggtgcaatgtttcacgcctgcactcccagcgctttgggaggctgaggcaggtggatcacttgaggtcaggagtttgagaccagcctggtcaacatggccaaaccccatctctactgaaaataaaaaaattagctggtgtggtggcccatgcctataatcccagctactagggaggctgaggcaggagaatcacttgaatcctggaccagaggttccattgagctgagatcacaccattgcactccagactgagtgacagagtgagactccatctcagaaaaaaaaaaatttagggggaaaaatcaaaagccatttctgagacacaaaaatacaggatttataaattatatatggtatatataaaaatatttttaaaatagtatatatagcatattatatataatgatatgtaatgttcatatattacatatttataaaaaaatctaatctcccttctcttgcttgctgaatagggggatgctttgcctgcctcttcctcttatattaaaaaataattcttaaagacattgtcagttcttggcttttatagcctcaatcaccaaattgtcggtaaaatggccctaaataatcattaaacaaatgtgtgtgagaggggaaataagaaggataagtaagtatggggaggattttgttataatttcaggaaatcaatatcaattttatgtaaagttttaaataaagcaatcccaactttaatgtttgatgtgtgaaaaattaggcaaaattccaaaagggctttataaactgaaaaaaactttactaacacctatccatttttattattttaaccaacttctattgagctgccactaagtacctgggaaacataaagttgtacaacatagaatgtgcaggtaaaagaggttgaaggaagaaaataataacactatgatagagataaattttaggataatagctaacacatatgatatgccagtcattgatctaagtacttcacgtgaattctttaatgcttacaacattactgtgaggtagatagagaggcacagtaaggataataacctgcctgagatcgaggaagaaagacaatgatgagatgtgaactcaggcagtttggttccagagtcctctcccttaaacctcatagttttcaacttctctgatattgtgtgggtgatgctgttggggctttcttcagggaaaactaagccaggagagagaatggatgctagtgagatattcctgaagaaggaaaaacttaagccaggcattaaagaatgagttggaattacctagctagataaaacgagaagggcaatccaggcagagggaacagactgtgcttttcactgaggtggaaaaaaaacagagtatatcagaggaattgtgattccatatggctgaagttaagggtatatgatgaggaagaaattgatgaggttgaatagagaggactggggctaaataatgggaatcctttgttgccagactgaggaattttgatgatggcctacaggcagtggcaactctgaaaggattgtaaacaggaaaataaaatcatcacatatagtttagttgcctatcaattagagctctctggatgcaagcaacagaaatcattctctgattaaatcaggcagaaagtaaatgtgctgtaattagcacaaaggcattggaacaaaacttacaaaaggaaaaagaatctgagcatgcctttctgggcatgtggctagcaagaagtattccagtctgtttgtgatactctcttttctccatcctgtgtgtaactctgttcaaattttaaagtcttaaaagagagtccagttcaccttgtttgggtcacatgttaatacatgagctagaagggagcagaaaactttgatttaaatccctctcctcccaaagtctcaaaattagggaaaggcaattctcctgaatagaaactgggttctattgacaatagaagaaggaaatgattctgaccaaccactaaacaataattgtccactgaactcagtcaagaacatgtagaataagttggaggatagagcaaataaaggagatttgtaggaggtaattattatgatctaaagcaagcttgttcaactcatggcctgtgagccacatgcgtcccaggatggctttgaatgtggcccaacacaaatttgtaaactttcttaaaacatgagatactttttgtgacttttttttgctcatcagctatcattagtgttagtgtattttatgtgtggcccaggacaattcttcttccagtgtggcccagggaagccaaaagattggatacagctgatctaaagcaacaggttcatctactcaacttcacaacgtgtagacctgaaataaagaccattcatataccaatacctgaaatataaatttgtttgaccatgacacgtacagtaattggttctcaataaatgtggatagcttgatggataatgtgaatgcaatgtgataaggaaacttcatattcaacaaagactggaatgtgaggattataattccaaagcaccagaagatagataagataatgcaatgagacattttatgactcaaggcaaagttagttatgagattcagaccaaaccttagacgtgcagtaattgaaatatttgccacagaaggggtataaggacatgacattcaagtaagctaacctttcactagctttagactttgaactcagaaaacatatttggtgaaaagcttatggtcccctttagtatgtattgcttgattaaagtattattttagaaaatggtgagctgcttccattttgaaataaaaataatttttactaagtgaattatattcagtgaaaaaaatggaagctacaattacaactttaatttttttaagttttaagaatacagccatttaaaaaaattaagcaaatctgcttcattttagacagtagaaaatataccattatcttttagaagaatagagatgtgaaatatgcaaattaagcctttagaagtaaagcacacatgaagttcaaagtttaatttctagaattgtgaatcaatagcagtggatgatttgtactttatagcttagtgtcggagaaatctgattaaaaaatgctttttctgtttcatcacataaacataagtaaaattgctctgaaacaacaatatttgacaagaattagcagttttcttttttgacataatctatcaaatgaagggaaaaatatgtcctgggttttgctttgagagtgattactaaatctgacccttaaggaaaggaaggagagaacaaagaagggaggaaagaaagggaaggaaggaggaggaaagggaaaaaaagaaggaagagaggaaggaaagcaggaaaaaggggaaggagagagaaaagacaaaagaaaggtagcaaggaaagaaaaaaagacaagaaaggaatattaaagaggacaaaagaggagtgaggaaaggaggaaatggaagagggatggtgggagacaggagggagaaaggtggagggggaaatatgaagagaggttcccagcagtggagactagtgttgctatcaacaaatagaatttagatggccatatgatattatttttcataatactggtgtctgattgcctgtgctgagttaattgtagtcttttttttcaattccgtttggccaggtgttcaggataattcaccacaaaatctcaaccactgcacttgtattgaataaagaattgagttggcaaaggcattttatcctccagtaagacctttccagattggggttgagacaaattggccaatctggacaagatgataatagcattgttcaagattaatttttaaccacacattgcactgttacctgggagatttcattatctaaaaattgaatgagcagttttagtgggtatagtgtatatttaaatgggacataattacttgaatgagtttaatttttgttgttgttgttaaggtcaaagtacttaaaaattatgattttttaaaactctgtctatacacaaaaagcatttgaattagctacagaataattctgattataacttttggtgaatagattcagtcaaaatctgattactaaacaacttgtgtagtatagccctggaagaattgatgggacaatgtgtgggtaaagtggcattggctatttaaactaaaagcaatacaaaacagaatgtttcttggttttattctgttgtcacaaacccagcagaaagtggctattacaatagtttcccttattcaacaaatgagagaagttatagacaatttagttaattgatctaaagtcacttagtaaatgtaattgtcctaacataaacccagacccccagacctcttgggaatagataatgtttcttacttcttttctatttcctcagccacccccctcaacttcttacacatctcatttctccatccaaattataacaaaacaaagcaaacatggtttatttccatgggcatcaaatggatttcacgaggttgggtgacagtcatcttagggtgaggagattgattattctgtttttctctttcatcgatcaacaatccagcccttctcatctcatcatttcatttctgcacaaacttgtttaagaaataccaattaagaaattaattaagaaattaatgttgtaatctgtttggctgaagatatttacaaattttgtgctttaattatcttccaacaaatgtacatgtctctggtagacagcttgcgaccatctggatgactgatccatatttatataattttctttctttacctaatgagaccaaatccactattatcttcaacgaaggatgtaaagatatgtcagtgtcagtaatgtgacttattttatattctctggtcataacaaaaataaaccgccccttaaataaaaaggtcatagagttgcaaacacacacacacacacacacacacacacaaaatcatattttctaagtctcctaattacctttttatggaaaatgataccatatgcttttttcttaaagaaactacataaacttataaactatactaaactacacatttcaaagtctatgaatggaaatgtgtatcttattatattttaattcaattcactgtaaacttttctgtcaaaatcttatcaagcaaaactgatccaggatatttacatgaattctgatggaagtcactgtactgtgttttccataaaataccagtgggattctgataaggaagtttatgtttgccattgtgtttaaatagagaattctgggccgggcatggtagctcacgcctgtaatcccagcactttgggaggctgaggcgggtgtatcacctgaggtcaggagtttgagaccagcctgaccaacatggagaaaccccgtctctactaaaaatacaaaattagccgggcgtggtggcgcatgcctgtagccccagctactcctgaggctgaggcaggagaatcgcttgaacccgggaggcagatgttgcagtgagccgagatcacaccattgcactccagcctgggcaacaagagcgaaactccgtctcaaataaataaataattagagaattctatttacaaatttcctttcttggatctagttagggctcctttatatggagtgatttttattgttttcatagaaatacgtagaatctgggtcttctctaactttcttacaggaaagcaatgtaataaggtttttttttaattttctgaaagttatataatgttattgttccctaaagtttaggacctgccttttaggctttccatttcaccataacttttggtccttaaagtctgtaattgaagttacagtgtgttatgatgtaaatttttcttattattacctttaatgttagggtaatgttaactaatgttaatgttaggtatatggttgtttttttcattccttcgttcaacaaattgtctttgaaacccatgttacaaagcactctagagtcaggttgaagactattaagaaaggagaatagaaagagacactagagtaataatttggatttaaatttgatttccttgtgtatgatagtgaataagtgtgaataagatgaggcagtgatcacacatcactattagtaaaagtgtttctgtacctgtatccacacttttatgtatatggttacttatgttaaagtgatacatattatataaaattaacgtatacattaagtagatattttaatagtctgtaattaaatactactagtattttctttcctccttcaagtgcttacttttgatacctcgagttacagtgtcataaagattctttagaaatatattgactgtcttttaagagcttttgatacaatactgagtttacattcatctgttatttattgaacacttgctggtgaaaggcatcagtgttatctgctcttagggaacaaaaattaaaaagggataggccctaattttagagtgtatcctctataagaaaaacataaaagatagggcagtcatggccacaaaagaaaaaagtgttatggtggtttcaatcatatatgtattagaatgaataaatcaactgatcaattgtgatttcttattctaaatatgtgcctgcctttttcatatagatgaaaattaagctatgtttatctttccagggatcttgttgatttttattcaataacttgggagtgaaagttgatttttgcatatgttttaatgtttttaaatttcataaatgaattgatcagtaatttccaaggtagtaatggctgcattgtttttgaaaaaaaaaaagcaacaggatttgattgtgcttttatgatttttaaagaattcattaaaaataatgccacggtttctaaaatgatttgagtcaatttcttattcgatttataaaaataactttgaatacaattttagtaattcacaaatgctttcagttcccttacctttatattttatattctgtgtaaacaagtgacataatatttaagaattatatatctcctatgatttattcaagaaaagaatatatactgtattatttatttcaagaacagaaatgctttgatttaactgtcatcttctctcttcaattatggaagcaaaataaactgtaatgaccaatgtaacccctcccccatatcaagttaatctatgttcaactccagaattatttttgaacactcaaactagaaattaaaaaaaattaaatccatgaagacgatttttgccaaaagcatatagataaattgagttgattctatacttaagaaagtggagaggagagagtaatttggagagagtaatttactcttaatcccatattttttccctaaatgtgaaagaagtagattgtagtgagagggaaaataacctgtagcaacttcattgaggctaagctttctgtcatgttatattatacgaaagtaatgaaatgcttccacagatagaatcagaagtcccctctgagaaattctacataaaaattagcctgccactttaccacacttactcaagtttgatttttttaagttatgtaatagatgttaggcactagaagaggacatttactgggggcaaagatcagtagttggaaagaatgcaagcaggcaagaagctatatataatgagattttacagtacaattgttttctaaatgaaaatgaggacgggtccagacacaatggctcacacttgtaatatcagtgccaggatggaggatcccttgaggccagaagttcaagagcaacctgggcaacagagtgagacttcatctctacaaaaaaatgaaataaaaagttagctggctgtgatggtgtgggcttgtagccttagctactcaggaggctgaggtgacatgatctcttgggcccaggagttcgaggctgcagtgagctatgatagcgccactggattccaacctgggcaatggaacaaaactccatttctaaaaaagaataaaatataaaactaaaataataaataaataaaaatgaggatatattttattttaacatttggaaactttgtaggtgaggaccatgcaaacattcaaggtgtgagttctgaccaaatccaattattaaccataccaatgacttaaggtttcttcacactccttaaagttgattaatataatgattatatagttgactggtatgtcacagcttgaagcctttgagatttattcctgccttttctgtaaaggttgttttgttaattccagtatgtactggtcgtttttgttttgttttgtttttgtttttgttttgtttttttgagatggagtctcgcactgttgcccgggctggagtgcagtggcacgatctcggctcactgcaacctccgccacctaggttcaagcgattctcctgcttcagcctcctgagtagctgggattacaggcactcaccaccacacccggctaattttttttatttttagtagagatggggtttcactatggtggccaggctggtctcaaatacctgacctcatgatccacctgccttggcctcccaaagtgcggggattacaggcgtgagccaccgtgcccggctgccaatatgtattggtctttttcatcaatgattcagtccaaaatcattttgtcctttaactatatattttcttgtaaagctgcttctgttgtcttgaacttttcttttcaaatgtatgttgtcatttgactttttagattgttattttctggtcctcgaaataaatttaaatttcctgtaaaggaaggtgtaatattctatttgacatagccgctaaagatgtactaggtgctttataaatattgttgatttactttatcttcacagattactagttttacttagtatttggaatatgacaacattttatagagctatattcatatatatgtttatcttaactgttaaatgcaatatgattcatgtcttgttttggtcaatgatgaatgaaagtctcctgagaattaaatttactgcatcgatgcaaaaacaatcataattttagacactctaagaattttagaaattaaaggattttttttttccagtttactctgttaagattgtgtttagctatgcgtgacagcattctcactacagtggcttatccagatagtttctttttctcatagagcaagacttccagaattatgtgttccagggtcagtgcagcacctccaaaaccgtatgtcccaactttttcctccaaccccagtcatctccaacatgagactttctttttgttttgttttgttgtttttgtttttgtttttgttttgagatggagtctctgtcgccaggctggagtgcagtggcgcgatctcgactcactgcaacctctgactccctggttcaagggattctcctgcctcagcctcctgagtagctgggattacgggaacgcaccaccacgcccagctaatttttgtatttttagtagagacggggtttcaccatgttggccaggatggtctcgatctcctgacctcatgatctgcctgcctcagcctcccaaagtggtgggattacaggcgtgagccaccgtgcccagcaagactttttttcctgtggtctcaacatggctactctgcctccaggcactatgtctgtactttaaaatggaagaagggaaaatggggaaagtaaaagcatattccagctgtgtcagctcctgtttgtaaggaaaaccagtgcttttctggcagccccacacagaagagtttctacttgaacagtgcattaaccagaaatgtgtcacgtgaccattcctaacttctaaggatcttgggaggattgagtgttttaactgaataggtgtgtttctttcttcataattcaaaatgtgaaaattggtaacttagttataaaaccttgctagtctgaacagaatttggatttttttagctaagaaggaaagaaagggtatcggataggcagctggctatgctagccaagatactcttaataatgcacatttttcttctttggacataagcagttttaacttagctaaatatgatgtgattgttttcctgtcttcttagttctgtttaaatttgtttcagaaatcaaggaaataaaatggagaaaaaactctattattcatgtctatctttctgcctctgaatatttttatgttggagaaagagaaagcagtaactttcataatagcttacatagtctgacaaattctaaacatgtccgttagcatcaatatacgtggtattaggtcatcagtttttatattctgaattattaagacccaaataaacccactgagttcaagagaaagtatacactgagcaataaaaacattaccagttctagcaatgataatcaaacaagaaaacaagtaatatagtctgtttagaataacatgttttaaagatcaagtttttcttccttaccaatgttgcctttcttgtaacacttttttttccttcttgagataggctttcctatcttttgtcacaaaccccaatatttacatggccattcgtagtctattcatagcagcaccaccccatggcccaaacttgtagatattgccctccttctatggttgttctaataagaataaccactcttgtctctcataatctcagctgttttgtgccgttaaaatggaaaataatgagtattaagatactaactaggggccaggcgcggtggctcacgcctgtaatcccagcactttgggaggatgaggcgggcggatcacgaggtcagaagattgagaccatcctggctaacacggtgaaaccacgtctctactaaaaatacaaaaaattagccaggcgtggtggtgggtgcctgtggtcccagctactcgggaggctactgcactccagcctgggcgacagagcaagactccatctcaaaaaaaaaaaaaaaaaaaatactaactaggtttcagtcatatgagatgaataagtcctacaaatctgtacagcctagggcttgtagttaacaatgttttatatttaaaactttgctaagagagtaaatctttttttacctgttattatcgtacatgcaaaaataatagtaaataaggaaggtaagagaaaaattttggaggtgatgcataggtttatggcatagattctggacatgatttcacaggggtatacagtcatgcattgctcaacaacagatatacattcggagaaatgcatggttagctgattgatcttgttgtgcaaacatcatacagtgtacttacacaaacctagatggtacatcctactatacatctaggttgtatggtatagcctattgctcctaggctataaaccagtacagcatgtgactgtactgaatacttcaggcaattggaacacgatggcaagtatttgtgtatctaatcacatctaaacatagaaaagttacagaaaaatattataatcttataggaccactgtcctacatgtatacagactgtgcacatgatagtggtccattgatcaaaatgtccttatgcagcacataactgtaattatctcgaaactcatcaagctgtgttcattaaatgtgtatagctttttatgtcaataaagtggttaagaaatcaataaagtggttaaaaaatattttgactaggaaatatactatcatttctagttgataaaagatctcaacatttccaaaattgtcctacagaaaaccaggttcatcaggtgttcatacatgatcctcatgaaaaggtcaaataagctgaaaaacatgcatagacgttgcctatcctagcaatctatgatgtacatctccatagtaaggtcactgaaaagtcttttaggaatgttagtattgttagctcagtatttctcagtgatttctccatggaaaccatttgtgtagagcatcttgaggagcacagctgagagaacattatcttagttggatgtgtatgtccctctgagtcacttgatttctctacatatgcttttaccaaattaatcttttagaaatcttttctcttcgcactatgtctataatttgtgaagttgttaccaggataacatttgtgcctctcaccatgatgtacctaccagggtccaagcagccattccttctctagagcaactgtctgagggaaagaatttaacacagcattctacgaaatcattttatttataaaaatagattactgctttacatatagtaatttatatttagaatattgattaattattaaaatctgcatgagagctttaaagagtagtacataatatatagcagtttgtactcaaactgtcttctaaaaaggattcactttttgtttgtattctattgtcctattcgttgatagtgttacgtaagtaattataaaacttaaaatctggaaagagaatgtggactcagaatgccatctcttttgttatttcaaatggattagaaatgaacatacatattcattttctttcattacacatccagagaaatagaatggattttataaatatgtaaaagcaaggattttgatcactgataaaaagggaaggtttggtcactaccttatttcattccttttttcttatccttttttttttttttgtcaattatttgatgacatctctgaacatcaccttttattcatgacaagaattgggtatcatggtaaagaacactgttaatataattcagttacttcaccccctcctgaaatatagagaagctttaagactatgtgaatatttttttctggttttcttgtatttgtagaaatagcatgagctttgtttaaagtcaggcatctaaaaccttgccctgtatgttattgacaacctgcacaaattttaggatctattctattacagtttgttcaactgtaaaactaggatagcaaactctatgtcatattttcgttatcagaatttaaaaagcatgttttaagatcttagtaaataataaatctctactctgtagttgaatttgttctatattctttaagaaattccctttgatggttatgccaacctctgtattacttttcttcacactttaactttgcgctgaaatcatagtagtattttacgttatcagtcaaaataacagtcatccttaaaacaaatatgaattttagatgattaaatagatttgtatggaggttcttcttgctaatcatagcagttatccttggtgaaaaatgatagacacttgaaaaaaccaattaatcatgatggctatttttgcatcataaataaagctttcaaatttgagagggaatcaaaagggcaatggtagtatagtgtctcaaagcccctttccaattgatggtacaaatttaaaaagagagagagagagagaaacatgtttcactgtaattgttttctaagagcttccaaaaaagcgtattttcttaatagattcaaatttttcagttggattgaaagggaagtcttggagtgtagtgaggagggcaccttctgttgagaggtgttcagacgacagagtgtgcccaaggccaaagatgagatggttttgcgaaagtcagtggccacaaacaggtgtgtttgacccctgagagatatgcaggaagtctaccccactttaattcttccaaatattctttaccttaattcccaagtacttgataaaggagcaatggggagaaaatatgcacactattatggaaaagttttgacctacactttggagagttttagattaagagcattctagaaatcagtcccaaatgcctagggtttacttacttaaagataatatcatagtttgggtgactgggaagcataccctgagattgaggtgagcatgcagtatgtctatttaggagtgttcttggggtcaacgtgtaggggcagagggagaagttgagctctgacgcagtcttagtaagggcctcagctgaccgttcagggagttcttaagctggaatgacccttcagaagtgctaggaaacgaagaaaggggactggatctttataaccccgtgtcaagtcatgcactggatgtgggctactccaggaaggcaacgaactttagcaagatgattctctttagccacgggaatttccataagggggctgctatggtctgaatgtttttgtccctccaaaatgtgtatgttgaaacctaacactcaaggtgatggtattagaaggtgggggtttgggggggtgattaggtcatgcgggctctgccttcagaaacaggatcagtgcccttataaaagcggctccagaaagcttccttgccctcccaccatgtaaggacacaccgaagatgccatttaacaggagtgggccctcaccagacaatgaatctgctgatgtcttgatcttggaattcccagcctccagaactataagcaataaattctgttgtttataaattacccagtctaaggtatttagctatagcggcccagactaagacaagggctgacagctgaaggctgtctaccagcagcactcctagcagctggggaactaagtccttcatttccaaaggggaatctaggcagcatatttacagcttttcactacagataagctcattatttcaaatagggactagcaggaaaaaattaaattgcccaaaatttagtgggatgctgaaatagattgtggtgtgtaaattggagtatagtgaggagagcaccttcaaaccagtatgtactacatgatattgtttttgttgcaatatttattatatacccaaacacacatatattacttttagaaacacacaccacatatatatctatgaatattttatatacacatagggaaggattgttgatgttatttatgctattttaaagatcgatgttttcatataattatgtattggttatatattatttcttgatataaggtaaaaaaaaaaagcaaaacaaactttaagtgatcactatgaaaagaatcccaatgctgcacatttaggtttatccaactcttcccattaaaatattaaatagtagaaataattgtgaataagaaagagcagattttgaaaaatggaaagaaatgcttaaagacatagcattgttgcccaaccatcattatttaaacatacagtgtttggctttgaccaaattgccttcaaacacttccttttggcccaaaatgttaggtcatatatactaccataaaattcatgatgcttaccatgcattaatttctagtatataccaggcattgtgctatgcatatcatattcaatatttctaatcctctcaaaagtggtacaagctaactggcgtttttcttgttttgaaagggagaaactcagagaggttaagtgacttgcccaaggcaatgccattgataagtgccagattctatcacaggtttattggcaacaaaccatatgtgcgcgtgcatgcgcgtgtgtgtgtgtgtgtgtgtgtgtgtacacatacacgaataacatatatggtataaatacgtggaaacataataaactgcattgagctgcgtttataattagtatttaggacatgtttggcaaataaaaacagtggagattgaaatggatttgcttaggaaaaatgatacattaaaataggctttattatgagtcttcaactattctgtgaaaatagatacccagggaagaaataatagagaatatgaatcttgagcaggcaactgagaacttgtcgaagagccaagataaaaatgtcagagaggagaatattttggcagctcagatgagcccccagagggtgggaggcaatgatctcaccgcagtctcgtatctgaaccccaggtttttgcatctccataaagtaatttcttacacccctcaataatgatcgggcttactctcaatctctcgctctctctctgtgtctctctcacgcacacaaacatgcagaacatttcttgcacatgcataactcataagacgattatgtaaataccagcctttttatttcataactaaattacaaggcctggttattgtttggactgtgaaaaaataattatgtgaataggtgcctcaagatgaaagacaaggcaagattgtgaaattattcatatgatagtaatagtatgcaaaaaataacacaatctttaaagatctttaacgacctagttataaaaccatgctttataacaaatataaccatgaggaaataaaaagaaaaatgtaataatatactccaagaataaagtcaaatgtattgttgaatgtaaggagttggttacacttccttatagtggaggttattttaaaatttgtggcttacgtggtgttatgaattgccctagatcaacactattatgcaaggccaactattaggttatttttggtagataaccacagcaaaactttagtataataggtaaaggttagctacactcccataccctcactctcaggtgttgtcatactccgtataaaaggttcaatcaagggagacatgagaatattccagaatctagaggcaggatgcagttaaccttagagaaggcatcagacaactagaatcttcggattcaatgtggaaacaaagcatagtttaggcattaaatcttgggcaccattccaaagaatacaggttccataacttactatatttttatacctagcaagctagagatgaggaattgctctcaaatattttaaccaaagcatgtatcttaagtaacactaatctcataagtgaaaactcatttctaatattcattttgctcattagcaaggcctctagtgttgactgtgataaaaaatagttcaaatgctggtagaacccaccccaggagactggcctttctgattaaattctaactctatccccacgtgaattcctgacttaagtaactgagttcctgcacatcagaatataagtatattatagatataaaaacatatgtaattaataaatattttaagtgagacacttctttcatctttatggcttaactatatcagacatttgattatttttagcggtctaactacaaaacaaaacacaaagcccacaactaaaaatttctttgtatatattgcaaagaggcaaccatttggtgtcaattcaatcatgagtgaaatgctattatacgagtacatctccctggcttgtatgggggtaatagggcatggaatttacagattcacaataactgagatattcacaataacaaagatatcaatatgtagcttttcccataactttgtgtaatgaaatcctcagtttgtgctgtgtaaaaagcttattgtttacttctcatgaaaatcatcttagtttttatctttatttaatagtctgtaatttgggggtaatacattcgttttgttgatactatgtgaagtggcaagcagaaaattctaacaggaatagataagcaagtatcctataaatcagagtcagtgtctctctctctctcttttaatgagtcagtctgtctctctctctttttccctgcctggctatctatctgtatttttcagttttgctttgcaaataagagaattgtgtgttgtaaaccaaccaacttaccattaattttctctgaattcaaaagcaattacaagcggactcttgagtttgtgctgcctggttgtctgcatataggccagatgtctagaataggatctttatttactatttttaccctcctaatttcatggtaactccaaggtagatgatatttgtaatcgtacactacttgtcagaaatctttctaataacactgctattttataaaaataaacattaattcagtataaaattttattttaaattgttaattcaagcaaatcagtgaggtaacttttacactgccgagcgtacgtgtgtgtggattagtacagccatgccatagacttcacttgtaatcttttctttatattttttatacacctgaaatgttcatcattgtgctgtagaaaacaatctcattgtgtttttaaaagctagagtgggtattgagaaggggaagaggatcatagaaaaagttggttaacatgctacttaacacttcaaatctttactcgatgtcatcatcagcaacattttaaatttatgcttctactagtttgcagttcttttcctttgattattcttatgatacaagcctttccacacaaaatttatgtacaggaattgtgtagaatttttctttggaaaatatggtgatttattacaatttgggcaacatcatcattttaaaaattcagaatttgatttttctcagaatcatcagaaagaataaagcatatatatggttcatgtcaggagaattagaacatgagaattaatatatctctgatcttttaaaatattttcatgtttgtgaatcagcagatttttcctagtttgagatttaaaaaatctagatataattaaaatctcactgatgtttcaccatcagatgattttatatttgtattttcttccacttcataacttgtatagagaagaatagaagaaagaaaaagggaggattgataatctttctctctcagttcttatagcacttcattttttaaacttattacttccttctgcctgctttgtttgtctacatgtttgtatttcatgatttcttagaaatccatctactgccattctgaaggtcatttacctgaaaatgatagaaagcagcatatattcaaacaactgcagagtaattgtctatatcagttatcattgttcattacttttctgttttaggattgaggggctgcctcgccacctccctcacacccccagcatattatcacaaagcctactgattcattcacatccctgggctgaatttgccacccactgtgtgttcctgttgttttgtgtatggaagtgaaaagatttaatttgatgttgttgaaaagacacagaggctaactttcaattttcatatgtagttcttccctctccctctgcaccacctcctttacttgttgagaaaattgccctctccatggtaacaatagaagaagctttcagattttagtagtagttgttgcagagaaaagaattcaaaaagtagatgaagtttaaaaatgaaaaagagagaggaagacagctgggaagaaggcttaatgtttatgagtgggtgtggaggggaagaactaagttgaatgaacaaagctgagctaaggggaagatggtttttctgcatcccagaaggcaataccctagcctttcctgcagccttcactccccaaaagataagagctttatctgaaattcttataggattcattcctgaagagcagcttgtcaccaaacagaaacactgtgatttcctcagggagtcacagtttattattatttttttaatgtaacgcttttgtgaactccagtttccacctcaattcaaatggtcttttggttacagggtgaaagagacccaacaatacacctttcccacttccggaggcctttggttaaaccatgtctgccacaaggacacaggagcctggtatgactggttgttttttgtttgcttttttgcctcctgtgctttctagattgtgagatactgtaactcttgtcgatgacacatagtaccgaacccacccgaagaagtatgtcagtatgtcacattgtgacaaacagcttctcatgctaagtaaatgcagaaccattgtgaaaggtttaataatgcccactcctcccccgccaaagatgtccatatcctaatcccaggaacctgtgaatatgttaccttacatggcaaaaggctttgtattaacagatgtggttaagttaaaaatcttgacacggagagatagcctgggttaccccagtgcgcccaatgtaatcacaagagtcctcctaagagagaaggaggtgatgatacaagcagagtaaaagagagattggaagatgctacactactggcattgaagatgaaggacagggccaagagccaagaaatgcaggcaggctctaaaagctggaaaaggcatggaaaagaatcctcccctacatcccttagagggaatgcaagctctgccaacacattgtttctagcttgtgagacccattttttggactttggacctccaaaattgtaagataataaatttgggttgttttaagccattaagtctgtaatcatttgttacaacagccacaggcagctaatacagccatgaacatttagtaatgactaactttgcacaattttaatacaagcttcttattaaggtttattttttcttaattacaaggaataaaagtggggtctgggggcaatgtcatggtccactccgttttagccatatgaatttgtatttccagcattagaacaaaaggtgacaaatctgaatgtatttgtgtgaaataataataaagcagaacaaaaagggaaaagtgtccagctggaaatgaagttagagaaagatgaggagaagcaagccaattgtgtagttttcccttctgctttttaaaatcatgatttgtttaacccactgaattctattttagaaacaggactgcaaggaagtgttgatggatttggtggcatgagaaccagagtcacagaggcaggaaagtaaggaataagtgttagaataggaagcagagttgcttgggaagagaccttatgacatgtggacagggctagacttaggagtcagaaagacctgagttcaaatgctatcctttagtatagtttgaagtcaggtagcgtgatgcctccagctttgttcttttggcttaggattgacttggcgatgcgggctcttttttggttccatatgaactttaaagtagttttttccaattctgtgaagaaagtcattggtagcttgatggggatggcattgaatctgtaaattaccttgggcagtatggccatttacacgatattgattcttcctacccatgagcacggaatgttcttccatttgtttgtgtcctcttttatttccttgagcagtggtttgtagttctccttgaagaggtccttcacatcgcttgtaagttggattcctaggtattttattctctttgaagcaattgtgaatgggagttcactcatgatttggctctctgtttgtctgtcgttggtgtataagaatgcttgtgatttttgtacattgattttgtatcctgagactttgctgaagttgcttatcagcttaaggagattttgggctgagacaatggggttttctagatatacaatcatgtcgtctgcaaacagggacaatttgacttcctcttctcctaattgaataccctttatttccttctcctgcctgattgccctggccagaacttccaacactatgttgaataggagtggtgagagagggcatccctgtcttgtgccagttttcaaagggaatgcttctatagtacaaggctacagtaaccaaaacagcatggtactggtaccaaaacagacatatagatcaatggaacagaacagagccctcagaagtaacgccgcatatctaccactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagacttaaacgttagacctaaaaccataaaaaccctagaagaaaacctaggcattaccattcaggacataggcatgggcaaggacttcatgtctaaaacaccaaaagcaagggcaacaaaagccaaaattgacaaatgggatctaactaaactaaagagcttctgcacagcaaaagaaactaccatcagagtgaacaggcaacctacaacatgggagaaaattttcgcaacctgcttatctgacaaagagctaatatccagaatctacaatgaactccaacaaatttacaagaaaaaaacaaacaaccccatccaaaagtgggcgaaggacatgaacagacacttctcaaaagaagacatttatgcagccaaaagacacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacactcttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacatgtatgtttattgaggcactatttacaatagcaaagacttggaaccaacccaaatgtccaacaatgatagactggattaagaaaatgtggcacatatacaccatggaatactatgcagccataaaaaaggatgagttcatgtcctttgtagggacatggatgaaattggaaatcatcattctcagtaaactattgcaagaacaaaaaaccaaacaccgcatattctcattcataggtgggaattgaacaatgagaacacatggacacaggaaggggaacatcacactctggggactgttgtggggtggggggaggggggagggatggcattgggagatatacctaatgctagatgacgggttagtgggtgcagcgtgccagcatggcacatgtatacatatgtaactaacctgcacattgtgcacatgtaccctaaaacttaaagtataataataataataataataaaatctcaaaataattaaaaaaagaaacaaacaaatgctatcctgatcctaactggctggctgtctttggggaagttggtaatcttttctgtgcttatttcctcatgtgtaaaaaaatgaatatagtacccagctaggtagagttgttgttgggattaaatgatgactataaagcatctagcccagcttcggctacattatagctgcttacgaaattgtagttacgatgtaaaagagaaaaacactggaaaaggaggatatgggccattttattccaccttcaccaccttttagcttggtgaccttgggcaaattatgcttcattccgtgcttcattttccttgtctataaaagggtgtaagtacagaaccattgaggggtggtcattattaacctacctcaaatggtgtctgtaagttaatatatattgtgcttttcctatgtacaatatctagcacataattacaaatcaaatccatcccatgtgcaatatctagcacataggaaaagcacaataactagttattactcttgttgtagtaattgctacgctgtaggagtttgaattgtaaggcagtggagagtcactgacctttacgagaaagtgtagcagaacatttgagtagatagtaatggggaatattacataaatggatagatattaggggcagatattactattaaaatattacagcatggatatttattaaggccaaactggttaattagttgcatctctcaggttcctaatgttgcttaattttttaacctcccattttgtgctgccctttgtacgaatatttaatgctcccaacacctcttcagtagcacatgtactgtgagtttgttttgttattacttgtgtgtattagcattcctttgtgaaccaaaagcatggaattagctgttgcctctaggctacctagttttgtagtttggattgaagccttcacctcagtaacacctattctgtctactatcttacagaaaacttgtaaaattaagacagatcattaatatagcagaaagagacaaagggcagagaacattgagatactggatattggaaccacccaatagtgttgatttatttatgattatcagtttttgtctctgcctagcctcatgccactaaagtctctgaggcaacaaagaataagcaattttgctcaccttatacaaataaaacacagaaaaaggaatcactagagaaatggtactgcagcctttctgcagggattactgcttatttttaaattacttaaaaggtattgaaattattgttcataatgagaaacctgcctaataaaacagaaaattaaacttaacacttccctataatgtaaacagctcggttaggaacacaacattacagaaaccacttaagaattgattgtacttgttcttggagcagaactagaagctcaccgtttagaagctgtgcacatttccctatcaaacagtacataaagtttccatattcctcagaatcggcttcatttgtgccatgtgtttgcttggaactatgccacagaaagcagttctccccctcaagctgggctcctttcatgccgcagtgcaagtgtgtgatatactggcaccatgtgctaatgtagacccatttttatatgataagaattagtacggcctagggaatagacaagtatgtctaaaatcctccccatagaatatgtcccttcctttaaaagctgtcatactgtaagttccagctgagttaaaggccactgtgctcctatagggaaatatattctattgtaatttttacgttctccaataacagtctgttctttgtttactgaagagagctttcatgtcataaaatggtgttttttgacagagaagcagaatcattgttttattatagaaatttgctcttacaacagcaaaaataaatagctcatctcttaagctcctgatcaatgtctaacacctcctacccccagcaacacttcactgcaagtatattaacactctataatagcaattccactcacctaccaagaaatgatcttcacaaatgatttacagctaaaccagagcttaaacacatagcacccaatcaagggcagatttttatctttttcccagtcatataagttctgagaagaaatagattaatgttgatctcccagacaactgctgagaaaatgtacaaaggatgttgtttattttgaagaatgagacctagttgttaagcactttttccccttatatgtacgtccaaaggtaaccattacaccattttgatgcaaatttaggatatatatttattcatacctctcttctccattcggatgttgtctgtgtgagtgctcacagacacatgcacacatacacacatgcactcctgtttcacacttatttgtaaaactcacaaggatttccaagccattaatatagcattgtttaaggtgaacacatggttgttcaccatccatatgtatcttcactttgtagcactcagaatttggcaaaatcagaaggctgaaacctcatggattaaatatattctatataacatatgtcttaattgctgttactgtaaagaaacctggactagccatatttgactaatttctacctaaggtatttgaattcttataaatagattcattgctttaatcacacaagagtggtttatatgaatgtaattatctccactttatagctgaataaactgagcctgattctatccctatatgggaaacatgaattgaacagctgtgccaattattttgataattcaaatttcacatctaccatgtgaagacagcagaagagggttagggggcttgaattattctgattaactgtgttcatgagtgtaatcgcctctagataatcactcatttcttcacttcacttcccatctacaggtagtatcagcgaatggtaacatctcttgctttgcctcagtttattgatggctgccgttagaaataaaaagcatggttttgtttcagtacttaaatgaataatatcttcaaaatgtttttaaaacgtgaaaaggttgaatgcatttttaacaaatgttttgttagctttgacttttatttttgaacagatgagcacaataccccagtactcctttcctagaaataggagtactacctgaagacttatttcccaaagaaaaatatcaggtctagtgcagcaatacgtattaagggcattgaaaagttatattcacaaaatgtgacatcataacatatgttaatacttcttatcactgataataatccttgaagttgtatttccagagagatctcaatttcttctcacactctgaaagtctctgtttatcctttagagtaggaatgtaagaatttaacaaaacattctgaatgtttaccttttttctaaactgaaactacaatccctttttacccctatatagtaaaatataatattacaagtagaatcagcaaatttgtttaataattctttgggacagtttttacaagcaatggggttgaatttatgttccttgtgtgcagtggagttattatattcttcttaaaaagatgcatgaaggtaaattagaaatgttttacatgttttcatgacaggacatttaatcaaagaggagatacaagaggcttttcttgggttactgcaatttaattttccatttctttcttggaagggacattggatgcagttgtacgaggttaatatttctaacatgccacttttattgtggcattcttctgctctcaaacctctgatgatttcccatggccttcaacatgatgtccttatttgggcatctagtgttctgagccctcacattctggccccagcttcccttctcaacttgatcacagccatcgtaattctgctaactaattacacagctgcccttcccactctttctcaaccactctgctgtattctgacttctacactttagttttaaagctactccttgtcctgaaattccttctcccattaggtcattattaattgagttcatcctctaagttacagttcatgttgctgttcctctatggcaccttccctgaacctggtcccatataaaatcccatctctcagaatcccattagggtaggatatgtggtctgtagactattacgtttgtcatttacatattgtcttctattattgggtaactgcgtgtgcgagcatgcatgggctggcctgaaggtcacctccccaactgcattgaaagttcatcacaagttcaattatttcactagagagtctctttcatgtcatccatgaggcacattccctactgtgatgtgttatgcatacaattatttcaataaatattttctagctctttgattgaccaaagcttaattacctgtcaactctagcctcttgtatctggaatttctacagtctttggatagtatctttaggatgcaaaattaggaggagtatgtaccaggcaaactattacaaataatgccctcaaatagttacatttcactattcatgtcttgtaatttatcttctgctttggtattttagtacacttatgattcaatttgctgtatagattcctctgaatagggacaagagaattcgtcttgataagtggaagttcgaaggattccaaaatgatgttattcaaggtagaacaagaaattaatactgaaaaaattgaggagtaataatccccaaatatgtacatgcgtatctcgttttattgggtttcactttattgcactttgcagatatttcactttttgtaaattgaaagtttgtggcaaggctgcattgagcaagtccgtcgggcacaatttttccaacagcatgtgctcgctttacgtctctgtgtcacgttttggtaatttgctcaatatttcaaacattattattattattatatttgttatgatctgtgatcagtgacctttgatgttactattgtaattgttttgagatgtcatgaactgcactcatatgagatggcaaactttgtggggtgcagtggctcacacctgtaatcctaacactttgggaggccaaggcaggaggatcgtgttagcccagaagtttgagaccagtctgggaaacaaagtgagaccctgtctttaaaatatatatgtagaaaaattaactgggcatggtggcacatggctgtaaggagccctgccagctgcatgggaggctgacacaggaggatcacttgagcccaggaggtcaaggcggcagtaagccatgttcactccagtgccctccagccagaatgacagagcaagaccctgtgtggaaaaaaaaaaaaagacaaacattttttcaactttgattttagattcagggagtacatgtgtaggtttattaccttgatatattacatgatgccgaggtttggagtacaaatgatactgtcacccaggtactgagcatagtaaccgatagttagtttttcaacccttgtttccctccctccccactctagtagtcctccgtttctattgttgccatcattatgtccatgacaacgcactgtttagctccacatgagaacacgtggtatttggtattgtgtttctgcattaattcacttagaataatggcctccagctgcatccatgttgctgcaaaggacatgattttgttcttttttatggctgcatagtattccatggtgtatatgcaccgtattttctttctccagtctgccactgatgggcacctaggctgacttcatacctttgctattgtgaatagtgctgaaatgaggatgagaatacatgtggttttttagtaaagcaatttgttttatttgggctatatgcccagtaatgggatcactaggttgaacgatagttgtgttttaagtcctttgagaaatcttcaaactgtttcactgtggctgaactaatttgcattcccagcaacagtgtatcagagttccctcttctctacagcgtcagcagcatctgtcatttttttgactttttaataatagccagtatgaatggtgtgagacggtatctcgttgtggttttgatttgcatttctctgatgttgagtgatgtggagcattttttcatgtttgttggccacttgtatgtcttcttttgagtagtgtctgtttatgtcttttgcccattttttttgatggggttatttgtttttgacttgttgaattgtttaagttccctatagattctgaatattagacctttgtcagatgcatagtttgcaaatatattctcttattctgtagactgtctgtttactctgttgataaattctttcactgtgaagagctctttagtttaattaagttccacttgtcaatttttggttttgttataattgcttttgaggacttagttataaattctttcccaagtctgatgtccagagtggtgtttcctaggctttcttataggattcttataatttgagatctaatgtttaaacctttattccatcttgagttaatttttgtatatggtgtaaggagggggtccagttgcattcttctgcatatggctaaccagccatcccagcatcatgtcttaaatacagagtccttttcccattacttattttcataagatggcaaacttaatcaatcaatgttttgtgtgttctggctactccactgatcagccattccctcatctctcttcctctccttgggcctccctattccctgagacacaacaatattgaaattatgccagtcagtaaccctacaatgtcctctaagtgttcatgggaaaaaaaagagtcacatgtttgtcactttaaatcaaaagtcagaaatgattaagattggtgaggaaggcatgtcaaaagccaagacaggctgaaagccagacctcttgtgccagttggccaagttgtgaatgcaaaggaaacgttcttgaagaaaattaaaagtgctactctgttgaacacaggaataagaaagtggaacggccttatttttaatatggagaatgtcttagtggtctggatagaggatcaaaacagccacaccattatcttaagcaaaaggctaatctaaagcaaaggactaattctctgcaattctgtgaatgccgagagaggtgaggaagctgcagcagaaaagttggaagctagcagaagtatgttcatgagccttaatgaataagccctctctataacataaaagtgcaaggcagagcaacaagtgctgatggagaagctgcagcaaactatccagaagatcaaactaacatctaagttaataaaggtggcaatactaaacaacacattttcaatatagacgaaacagccttctattggaaaaggatgccatctaggactttcatagctagagagaagtcaatgcctggcttcaaaagttcaaaggacaggctgactgtcttgtgaggggctaatgcaactggtgactttcagttgaagccagtgctcgtttaccattccaaaaatcctagggcccttcaggttatgctagatctagtctgcctatgctctgtaaatcaaacaacaaagactagatgactgcacatctctttacagcatggtttgatgaacattttgagccctctgttgagacctacttctcaaaaaaatgtgtctttcaaaatattactgctctttgacaatgtccctggtcacccaagagccctgaggaatatgtccaaagagaatgattttattttcatacctgctaacacaacatccattctgcagtccttggatcaagaagtcacttcaactttcaagtcttattacttaaatcatacatttcataaaggtatagctgctatattgtggtgagtccactgatggatctggataaagtaaactgaaaacggaaagtcctcaccattccagatgccatgaagaaaattcatgattgaggggaggaggtcaaaatatcaacattatcaggagtttggaagtagttaattccaacactcatcaatgactttgagggtccaagacttcagtagaagaagtcactgcagatgtggtagaaatagcatgagaaccagaatgagaagtggagtcagaaggtgtgactgaatagctgtaatctcaaggtaaaacttcagcggatccagagttgctgcttatggatgagcaaagattgtggtttcatgagatgcactctactcttggtgatgatgctgtgaacattgttgaaatgacaacaaaggatttagaatattccataaacttagttgataaattagcatcagggtttgagaagattgactcaaattttgaaagaagttctactgagtaaaatgctatcaaacagcatcacatgctacaaagaaatcattggctataaaggagagccaatcgatgcagcaaacttcgttgttgtcttattttaagaaattgctacagccatcccgaccttcagcaaccgccaccctgatcaatcagcagccatcctcactgaggcaagagcctgtaccagcaaaaagattatgactccctgcaggctcagatgattgttaccattttttttaggagtaatgtattttcaaattaaggtatgtacattttttagatacaatgctattgcacacttgacagatgatagtagagtgtaaacataacatttaatgcactggggaaccaaaaatattcgtgtgcctcattttattgtgatatttactttattgcagcagtctggaaccaaacacacaatattccaaggcagtcctatatattgtttcatgtctctctttcttctaaaatgtgtgtaggagaaaaaattatatcacttatgttactgggccataatatcaaaagcctgcgaatctgatgcacatgataaaaactggtcttaaacctgtcttgattatcctttgttaatatgccaaatttatagaacaatagagtttcaagaaatgtgaacaatgtagaataactaaaagatctaacgttgaatagctaaaattatcaacgccctttatatcactttagaaatgcgtttgcaaatcattatcaacaaattgtagcataaaattctttttttttcttgactttgaaattgtatttcaagatccgcaatttacaccacattatttacttactggcttgtgaaagtgaaaggcattttcatttttggatgttaagggttttagtaaatgacaagtaaatcaatcctttaagttccgtgtggtataatagcttggaaaggaccatcttaatctttttttcaacacagggagataatttattttaaaaataacacactaatagtagattaatattattaccatttcaaagaagtcaccaaatttggtaggcttaagaggttttttttttttttttgagattactatgctctttttttattttatttattttatatttatttatttattttttagttttttaattttactttaagttctgggatacatgtgcagaacgtgcaggtttgttacctaggtatacatgtatcatggtggtttgctatactcatcaacccaacatccaggttttaagcccccaatgcattaggtatttgtcctaatgctctctgtccccttgcccctcaccccttgacaggccccggtgtgtgatgttcccctccctgtgtccatgtgttctcattgttcaattcccacttacgagtgagaacatgcagtgctaggcttaagagtttttttaactccccaaaatatcaacaaattgaaacattactacaaagaaatagagaaataaatttcactgactgtcttattgttttttaagtttgaatagctaataatgatttcttaaacagctatcatattttttatttttaaagctagccaaatgatcagtgatttttataatactgataaatactgcttagaaaaggaacatgtgttctagcaatttccacacatttctgattctaattacttgtttctttttgttttatttttatatttttaagttttgtgagtacctagcaggtgtatatatttatttggtacttgagatgttttgatacaggcatgcaatgtgtagtaagcacatcatgtaaaatggggtattcaacccctcaagcatttattctttatgttccaaacaatccaattatactcttttaattaatgtaaaatgtacaattaaatcattattggttatagtccccctgttgtgctatcaaatagtaggtcttactcattctttctaactaattttttgtacccagtaactatacctacaccacccccacctccccacgacccttcccatcctcaggtaaccatccttctactctctatgtccatgagttcaattgttttgaattttaaatcccacaaataagtgagaacatgcaatgtttgtctttctgtgtctgatttatttcacctagcatactgacctccatttccaacaatgttgttgcagatgacagaatctcattcttttttgtggctgagtagtattccattgtgcataggtaccacatgttctttgtccattcatctactgatggacacttaggttgcttccaaatcttggctattgtgaatagcgctgcaataaacatgggagtgcagatatctcttcaatatactgatttattttcttttgggtatatacccagcagcgggaatgctatattatatggtagctctatttttagttttttgaggaacctccaaacggttctccatagtggttgtgctaatttacatttccaccaacagtatacaagggttcctttttcttcacatacttgtcaacattggttattgcctgtcttttggatataagccattttaacgggagtgaggtaatatgtcattgtaattttgattttcatttctctggttatcaatgattcagtgatgttgagcaccttttcatatgcttgtttgccatttgtatgtattcttgatctgccacaagtctctaattacttgtttcttgtaccactgtttcccttcattgtagtcagtgatttggtcaatcaacactttttacgtatgggtatctgttaactgtatttctaggaatggaccaagaattgagaaatttatcccaaccagaaagaacaaaatctatggaggcacaggattactgaaagctttgctcctatagcctcagtttttttctgcaagttcgctgcttcccagttgtccttgtgataaaattcaaaacctcaaactgatttttaaaaagccaactatatactgcttctactatgtctacctaaacttatttgccattatttgtaaagaattccaggctctaaccagcccatttgaggctttattttacgttcatgcctttgttcatgtctgtctttcccttataatgctcttctcattctctagccaaatctgccaaagttcagctgtagtgccatacttgatatgaagtctttgctgagaattcccatatgtggtcatttccttcactgatttgtttcaatagttgttgccattattattattttttttatactgttgctggatactttcgcagatccaatctctaacctgttgttctaccctaggaggttgaccaatatggcagtagcattgggcttgcttgtctattggcttggtccttgtgttgggaggcatcagcagatcaatggatgagaggagagtgagtcgagggatggctaggttcctttactcacagccccagctcctgtcaagaggtcttgtccctgcagccacttctcagattctactaactataccctccccttagcctttcaggccttgaggaggaaagcctcctcatcccactttgaatgaactatttattgcaagaaccatgactgattcagaatataatctgtccttgaatgaaatagttaatttccccttttgtattctcgtttcatatccctgtccctttatccattcctatattatatcatactatcatatagctaccttatattatactatgacatgagtaccttgtaagtatatcatgctatattatagttcttaagtgtgtgggctttggggccaacttacctatgttagaagttctgccacttattaccatgtgatcctagacaaattgtttaacttctttttcattcattttctttactagtaaaataggggcaatattagtacccacctcacagagtaatatgataattacattgactgatagtttttatttaaaacttttattgttcttactatgaaatgggaaatgttctaaacaccttacaaatattaactctattaattctcataatgaatctgagaggtagagactcagtatctccatttcacagtgctggaaatgatacagacagcatttaagtaacatactgaaaatagtaaaccgaataggtggcagccagtatgcaaattgggaaagcctgactccagagttcattcttttaactagtatgctgtgatagactcttttggcatatggtatgcactcaataaacaactattgttgttgtcgttagcattacttcccattgtattattacacaaaaaataattgtttatgagtatttgtttgctagattataagttccttgaaaaaagaagacaagttttatttgtctatgtgtactagctgagtgcttggcaaatagttgcagtttagtaaatgtttctaaaacaaattattagttgtttcttatgtatttcccaagtctatcctagccttggaaacagctaacacttagctaaacctagaaatgtcatttgagatttcagcagccatcattgttgctgaagccacaggttctcctttttatctccaatttcttcctcagatgattcaccactttctttgtcgtttccctacttcatttttcctatagtgacttttgttctccaataaccattgatagtgatgacagtcccaccttggaaccacttctaactgtcctgttcagcttttcctgaggccagatttcccccaaaatacattttttagcttcataactgctccttccagaaatttgaaacgcattctcaggaattaagcaagaggcatttgattgacgtcatttaatttgtgtttaaatgtgttcttcccatcaacgattaaccagtgcttcagccaagatacataacttttattctccactaaccttagggttgaggtcacaatcaggtacgtaatctgtagagcccagtgaaaaatgaaaacgcagggcccttggttaaaaaaaaattaagaatttcaagatggcaacagtagagcatgaaaccaagtatgaatcccttctaatgcagatccttgtgtaactaactgcacaagttatacgttcaagaagctggtcctggttgaggtctttgtctacctagggcacttctcactcagagaggtggaataatcttaactttctgtcttccgtcatctgaaaacttgccccaaagttccttttgccatctcttgcagcaaacctagtggttgttatctgttaaggattcctggtggcttgctttagtttcctacagttcttgagctgcatgtgttgaatggaactccaccattaccatgtaacacatctgaatactcttattttcctccagttaaattctgcgctccttggaaataatggtcatgcaccctaccttagtgatttctaaatagaggtagtatgtaaaaatacatatttacttgaattgcatcttaagaggccagcccatgggaggcatgaagaaacctatgttactaattaatattcaataattgacagttacacattcaggtagtagtgtcatggaaccatcacgttacatggaactgaagagctgatgagaggtttagggtctaggaggacaaaagtgagtgtattagtcagggcctgaggttatatgtacccagacaggataaaatgggacaatattttattagtggaaatatctatgtgaaagaaaagaaggaggaagccaaggaaggtgcaagagatgttagatcaagatgcaattctgactctgcaaggaagagagagggagagaaggctaggcagaagcatcccagtgtgcggtctagtggaaggaaattttggcaaagctgttgggaagtcattgaggcagagccaggcaaagaagtcccatgtctcccaaggaaggctctctgccttagtattcccaccacacccaatcattgggtgaggagaagtctgtgagaagcttggctttggtgcagtgcaatcatggatttcaaaatgcagtaacaggagtcctcagtcagttaagacccaataatagaaggcctgcatattctcatggtggccacttgggtatgaggagcagtggtgtttaaaactgttttgtataatttaaataaagaaaagctgaggactacttaagcttgattccttcagaagacagtctttggcctttatatttcatgtgatatctttgccatatgctctgataactctccatgtttcccctaccataatacctcaggttgttgcaattgcttttttattgcctgtcatcactactcgtttgttttctctttgagaacaggaattattttctccttcactgctacagcccctgcacctagctcaatgagtgacacaacagaagcacttaaaaaattgctataactcaaatttgggggatattctacaaaatacctggcctctgttggtcaaaactgtaagtgttataaagttcaaagaaaggcaaataactatttcaacttaaaaaagactaaggagatacgacaactaaaagcaatgcgtgagtctggaccagaccaggaaataaaaatatagctataaagttcattaatggggtaattgtcatactctgaatatagagtatggataagattatggtactaaagccacgctaaatttcctgactttgaaactgagctgaggttatttaagagaatgtctttgctattaagaaataaaacctaaagtatttaagggtaaaggggcatgatatctgcaaattattctcaaatgattcagaaaaaaaatatatatatataaaacattacatatacagttatatatctatacacacagagagaatgataaaatgataaataattaaaaataatgtggcaaaatgttaacaaatggtgaatccgggcaagggttacctgggagttctttatcttgcaaatattctgcaagcttgaaattatataaaaataaaatgcatcttataaagtatttattcagtgaataaagaacaaaaaaggctaactgcagttggaagatatttatgaagttggttatgaagattcttaagaagttaccgatggaggtgctagtagaacattcaaaaaagaagtagggaaggttgaccaagtaggaaaatatcaatatccaagccagtataaaatggaaatgagaagtgaggaagtaagtggaagacaatgaggatggttttcgatttggccactctatttggagaggcagccgaatgcaagaatagaagccagaagaagatgctcagtgagatggttgaaagctagatagattacagcatcctcaccagtaaaaccctttcggtaactagaaaggctacaatttagtaccttcctgacttctatgcttattttcttcaatacataaaatggttccgtaaactcttttaccttctgaattctttatattaattttttgaagttgtaaataaaatagcatcagttctacattgttacatttcagcttaattcatattcatttactgaaaatgggaacatttgaaaaatcatcatgggcatttatgctatgtagattgttgatttttatagaaaaatataaaaatatgaccagtttgattttcaaagtcttttcttagacatgtaaatactaagcattcaactcaacatatagagtttttatttgagtattatttaggtggaattctattttaatgaatacaataaaaaattgtaattttgtctaaaagcctaaaatgccctagttataatatgtatgatttcactgtttaacttcctatttcatagggttgctatttataaccacttcactcaactctggggggacttagtgagattaaagacttctgattcactttgtatttgaagaattttttttcctccatctttgctcagctagtggaatccatgatgaattctcatctccaaggggtaagcagtttttagtaaagcccagtagctgacttatgactccttagaaatagcattgattccttccttctcctgtgttttgtttcctctagaatgatagaatccatgtagacacgatccattatcatgcttaggtactggtaagcatgtaatgattttagttttgttcgctttaagttatttgtgtcacaaatatctgggatcatatcagagaaataaataagcacaattagcattctacttgtttgttatgactaaagctaggttgaggaaacagaaaaggaccagaggtcatatgaggatgaagataatactaggaacagcatgtttgggagagtaacatctggtaggggtagcagattgggggcagagaacagaattttatagatggatattttggaggcaagtagtttgagtaatgattagatctaaggtgttttctcatctgtgggtggctcgaaggaatagaggtgaaggtcagtttatttgagaagttctggaattataaaactaagttgaagtcaaagaaagtatagtagcaaataaatagaatacccttaaaaggaaaccaaatgaaaaataatcgttactctcaccatatgcttgtgttcttattagcaagaaattcttttaaccactgtttttataatatcttaatgaaaaaatactgaagcgtatgccatattaaatccctctctttatttctagaaagggaatcaaaggagaaaattcccattctgctatactaaaagaccactaagtaaagagcctattagtgtatgataaatcccatagcaatatacattatcattttacagcttctttgttgaaatgaatgtttgtatgtgttgaccatagagtgggataaaaagttgaaattttgttttgaaatattttagaaatgcatagttgtactgcagttgtgaacctccttagatttttaaggaggctgcttcaaaggatctcattaataatcttctcaggtgcttacaaagcatgtgtctgtcagcagaattagagaatcacccaactagagaacaggtttcacaataccctgagacctattttgttcattagagaggaaaatggcttgttttgagtctaagttgacatgcttgctaatttcagcaataaaagctgttcattgtggtcaggtttaatttagagcctggtaaggttcagattaaagttgatcaacttacttttacaacatacttcttaaatgaactttgaaatcttaaaagaaggaaaaaagtatagcaaacagtgaataatgtatctaaaactgagaagcaaaaaaaatctggttatgtgagagtgaattaaaagaagaacaacccaataaagataatctttgttatataaaaatttccaagtatcgaaaagcacgatttttcatgtgagttacacactataccgaatatatttgtccactgccacatgcatagtccctagaatagtgcctagtgctgaaaaatatttattaaaatgaatggatgagtaaatgaatttatgtattttgccagccctgtgtatttaaagttctctgttaactttgaggtgaaaatttgacttcatctgaggtttctgggtaagtccgttttaaaaattctattgaacatattcaaacattttagggtaggcaattccaaagcaacctttcagcttcccatgtcacagatgaccagagtttcacattctaacactggaaaacatcttatttcataaaatctacctgctactatatggttcctactttaaaatttgttcagtactctccagctgacttatgccacttacttcaatagctgtctttggcaatttgttccatatttcaaacactctgttgtgtaaagaaaccataaaagttagaaacctgaaaattggattttttttctgagcaatcacagcttacaaatgtggaaaatttgttaaaagttagcccctccaatttttcaatacagagaggagaaagtgcctaaagtagatgtacaatgtttggaaaagttttttgcattattttactattaccaaaagcaattgagtttaaatcacaaagcctgtctccctacctcttcacagaagaaacactacagaatgatcaaaatttggcctttccaaaaccaaaattcgttagaaaatcagcaggagtcaaagtacagagtaaataactaagtttcatataagtttcagatacattactatctaccactttcatctcttcatcttcattggcctcatgtggtagaacatcatatttaaaattatacaaacttgctggcttgtttactagtgtggttattataagaaaaaaatgagaaaatatagataaaacatctgtcacatattgcttataaactaacagtaaatattacttgtattttccccaattaaaataaaatttactgagttttagaaccagagctagtcagatgcctttttttcataaatttcttcataaatacctctgagattgtggtccttaaatctagagagactaagatgacagagaaaatagacactgaagaaagggaagaatatcttaatgatttacattactacctataaattaaaaattgttaactttattatatttgtatttttatttaaaatagtgctatattaaagtcatttataatacaggggaataggaatactaacctgtaatctgatgctctccaaacttgcctaaatcataaaagttaattagataatttatttaaaatgcaagatttgcagccctttccactacatattcattagttctggagggaggcaaaaaggtttggtgattcttacggacaggcagcttaggagaaaagctgatttagctcgtctacttcaccttttcatttgacaggtgagaaatctcaggggtacaatgaagttaaataagtaatatctcttaaatcggttctgtgctttttctgtttttaaaataaatataccttaattttgacgtcacacagaatgatattataagtataaatagttatctatcttttaaatacattgtcgtaattcagaataacatttcttactcaaggcattcagacagtggtttaagtaatccgaggtactccggaatgtctccatttgagcctttaaatgaagaaaatctatagtcaagattttcatttgaaatatttttgatatctaagaatgaaacatatttcctgttaaattgttttctataaacccttatacagtaacatcttttttatttctaaaagtgttttggctggtctcacaattgtactttactttgtattatgtaaaaggaatacacaacgctgaagaaccctgatactaagggatatttgttcttacaggcaacaatgcaggatttggaacagaggcgtccccagttggaagaactcattaccgctgcccaaaatttgaaaaacaagaccagcaatcaagaggctagaacaatcattacggatcgaagtaagttttttaacaagcatgggacacacaaagcaagatgcatgacaagtttcaataaaaacttaagttcatatatccccctcacatttataaaaataatgtgaaataattgtaaatgataacaattgtgctgagattttcagtccataatgttaccttttaataaatgaatgtaattccattgaatagaagaaatacatttttaaatcaattcagggcttatatagttgcaaagcatgcattgatgggtgtggtgaccacagtgtggcagaacatttgtggcagaacatttgttctttagttgtcatctgggctggcatccatggagatgccagtctctccctcatatccttggctgttggtccaagcaggcagtggcttcttcctgggccatctttcattcccatgtgcagtgactttcagatctggatatctctccgctactttgatgcccccattttgtaatatcaaaaatcatcgtactgtaccttatgccgtagtagggtgggcaggaactttggtaagacccatctgactagacgctgtgcatattcttttcttctgacatacactcctatccatttaatggggagagtgattcgcagtgattgtgtgttgtgtcagtgagtttccatggggtcaggaagagtgacagacgaaggagtaggggaaactcgccacccggtttccctcagagattctcctcagaaatgaggtccaagtcagctctgctttcaggttctctcagatctctctcggtttcttcacttctctctaccttccttccctccagggacacacactggtattgaattttcttgcttcctctgcaatatcccctcattttccttcccacaacccgaagaatcctttgtagtgcaggaaggaggaaaacctttcagccatctttttttttctctttgaaatcttttgtcttttaccaggcttagacttttcaaactcggaaaccatgagagtctatatcttcataatttatattctgctatgttaacccttccctaaggaaatgactagttgtcaatatgttggggaaagtgaaagagtaaccagagtaaaaggttaatattttaaaatattattagtcatacttccacatattgggtaagtacttattgataatagctagtatttattcagtacctcataagcattagatggtgtgtgcacatgtgtgtgtttctgtgtgtttctgtgtgtgtgtacaaaatctttacagaatcttgtgagctatattttataatccccattttatagacgagaaaacaggttccaagaacagttactcggccgggcgcggtggctcacgcctgtaatcccagcacttggggaggccgaggcgggcggatcacgaggtcaggagatcgagaccatcctggctaacacggtgaaaccccgtctctactaaaaatacaaaaaaaaattagccgggcgtggtggcgggcgcctgtagtcccagctacttgggaggctgaggcaggagaatggcgtgaacccgggaggcggagcttgcagtgagccgagattgcgccactgcactccagcctgggcgacagagcgagactgcgtcgtttacaaacaagcaaagaacagagcttggaatttgtaaatgtctctttctgacttgaaaatctgcgctctttctagtatgtttaccatttcccatcttgttttgttgcttttgttaatgaccttaatcattgtactaagactaaatacttcttttgtctgaaattatgtatgttttgattcacttcctaaagacatgtcttctttcagttgtagtgattgctaattaaaataggctgttcttggttttgaaagtttaactctttattgttgcttaaacaatgaatgtggatgtatgctaatgtattatttcagtaacactagccactataacaggtaatctcccaaatcttggaggcttactacagcagaaatttacttcttattttagtgcagtccaaaataagcagccctctatgaagtcattcaggaacccaagctccttccatcttttgtgtccagagcataagactcatatgcatttaatgggcagatgaagaatgagtattactcatgaaaatttgtcatgagccacgcctggaaatggtgtgtgttaattttgttcatattctgttggatggatcttgtcacatggtcacacctaactgcgagggaattagggaaatagtgtacactgttgagcctaggaagaggaacagatttggtaagatagccatacaattgatttagcagagcattcctccaccatactggaaccttgagggttctccaacaagttgcaacacactgacccaaaagagtgaatcttagtgagtgatttactcaatatgagactgaattcccattacacaggtaagtgatcagtttcttgcctgagaaatatggaaatttggcagtgaggtttatgcaaatctgaacatactatacagagagtcatttgttattttactaatgaaaaatcacttcaattttttccctaagaggaagacaatatgaatgtattatacagtatttgttcaacattgtctgaacattttccattatcccctgcatttttttttcatattgcattgactttttcatgatagagattaaaattgaatgaccggagggcaagtttgtatctctctgccaatattcagtgatttgaatagttcttcttttctaagcttttgtcttttaggaatgaatacctttatgaatatttgcagcctagtggaaaggctgtaatccaaatggtccaagaaagcattttcttaaaagcaagtgtctgtcgagatgtgtcatagcgcttattaagagtctaagctggaatcttagttccaaatatgcctggagcctctaaatggtaccaggataattctgacaagatatgtttatctaaacaatgtcatttgcagccctgctacacttcagtttatctctccctttgaaatctataaaatgggatggaaattcaatactcataaacttttcgatcgtgttcaaaatagaatttttcttagtaaagatttggttttcaggaaaaggacagaaataaaatacttgctcataaaattgtattttctcatttgatgattttggtcttcctttttattgccatgaaacttctagaaatgctcaaaaagaaatcagctaaataaagaaaaaatagttaatatatgtatgtaatactatattgaaacatttttctttctctggtaaatcccatttcataactttgaacagttgggaaaatctatacatagttattgcagtctatcaagagaaaagttcagtacaaagctatttatgtctactagaaatattcatgttaaacttcaagtaattgggtgtgcaagccaccaccatgttttactatatgaaactattaccgtggtatctgttgtattcaggtaattatattgatggaaatcatgcagtaataatctaggtaagagagtaaattttgtctaaatcagatcaaatgaaaaattctccctctttctaatattcgaattgctcatttttctttaactctttggtgtctgaatttgtcaatcattcctggccattttcttctgcaaaagggctgggtcaggggaccaaaagcagataagattagaagaatttaaattttcttccttggaggcgtctgaattacatgaaactcttgttcgtgtctgttaatactgcaaggcataataccataataccttgcatagcagtgaagaggatttggaaagataaaactgcttccttttatcattctgtttatttcacaaacaatattggtgaatgtcgttcctgtaacatttggatttaagagccttgtttctgtagcttctccctccgtaacccccaccactaccatttcggggctatacagcaatagcatgcattactttaaaaggcaggctgcctagactggccacttgttagctttgtggccttgagcaaatgactaatctcagtaaactatctgctcttagtttccttctctgtaaaataggctcacttataactatctcatgggttgggaggattagatgaaataattaatgtagagcccttagatcagggccatagtaaaagctgaatgaatgttagcatttgttattttaattataatctattggggtgctttgaaggcttaatgcaaaatacttaatgagctttttggtagctgtttagttatttcgccccccaccaccaccccaaaaggagagatttaaaagaccgacaggagaaggttgcttggaaaagatggaataagatctataaatagaattaaacaaatattcaggaaagccttttgtgggaaatactgcaaaatttttattatctataaatttaataggtagataaaattactactcccattttagagacagaaaaccgagactcggagagctaacgtaacttgtctagggtcttaggaagatgacaagtgaggaagtagaattcaagcccacgtctatatgattttaaagcccgaggcacatcaaatggaaaaggctggttagtcagaaaaataggaaggtatatttatctgacaacttaaaatattaggactaacctcaggtaattatagtctggatatacatttttgctgctcctgtttatacttttgacttctgtgtatttgagtgtctaatcaaaggattgtcttttacatgtgttggagatgtacagactagtggaccccaatgatctattagctgtgtaaccttagccaagttaattctctttcctaaactgtggttctctcatctgtcatgtggggctaataatagtacttatgctggtagggtgattaagaaagtaaaataattggtgtttctaaagtaaatatgtggcacatattagatgctcattaaatggtacatattgttatggtgagatggatttggtacagagagaactggagatgggagaatatgaagggtgtataatgtggccttttattagctaaaccaagggaaggacttctgaaacagaattccaagttttaagagggagtcgtttattttggaattattttttcagctaaggatttttcaacccagtccagaattcttagagaaatttagtgatagcttataaattttaagaaaaggaattcacattatattgcataaagaactggtatacagggccatagaaggggagaatgttcttctgtatgagaataaaaaaaaacatctctcacacgatttttgaattaactgacagttttatagcagctttgtcaacccatcattcattgctgcaaccaaatctatgaaatccttcatggcgaaataaaaaggctctgttgttctccacatttgtatgaaatctctgttgctaatgaaatgccagccagtatcttcctctcaggtattgtctattagatggttgcttattttagaagaagtggagtcaaccatataaatttccttcttttgacatctagcacctgctgtcaacctgttatagctacaagcagctctcaaaattcacatccactaggatgccgctggcaaccaaagagttcagttcagttcagcgaacgtttgaatgcctactctgtgctatctaatatcagagatggtagaggggatacaggaaaaaagtaagattcagcctttgtctttaaagagctcacaatcaaatgtgggtatttggacaagtatatttaggcaaggcagtttaggataggtgcttcagtagagcagtattacaaaatgttgagagaaaactagaggaggagttttaaatgagggcttagtggaatgcttccaggaggaggctgaatttgacctggtcatgaataagactttgaaaagcagaaggaagctggagagggaagggtatttcaggaattgatgacaggagaatacataattagacctgttaacagtggggtggaagacgaatatcagcatgggagtgtgtgtgtgtgtgtgtgtgtgtgtgtgtgtgtgtgtgtgtgtgttgtggaggataagggagtaaatgaagtcagtaagaccagttagaaggcaagagagcccaagctggagcagtgaccatggagtaaaaagaaagaagtgaaattgagacataaggtggagctagaattaacaggattttgacattgattgcatatataaaactgtcaatctaagagaaggcctgcctctaagagttggagattgaattctttggaagattaatgtcataaccagagacaaactcaggataaggagttgattatgggagacaaagtaatgtgcttaacatgaagctagatgaccatactgagattttaaagaaatggttgaaaacatagagattgcaggagtgatgttacttttggacaagaattcaaaagttacctggaatgtctgagcttgcacagagagagggtacctggtgcaaagaaaagtgaacctaggaaaaagcctagaagttggtttacatttaaggaatttgagaagaggtagcaccacccaccccccacacaacccccaaccctgccaacttacaatatagaagcatttagacacacactgaataataattttttttttgagacagagtcctgctccattgcccaggctggagtgcagtggtgccatctttgctcactgcaactccgcctcccagattcaagctattctcttgcctcagcctaccgagtagctggcattacaggctcccaccatcatgcccagctaatttttttgtatttttagtagggacggggtttcgtcatgttggccaggctggtctcaaactcttgacttcaggtgatccacccgcctcggcctcccaaagtgctgggattacagacctgagccaccgcgcccagcctaaataatgaatttatagatgctacactgtatggtttcctttttctgctgctgtacaaccattcaagtaacataagtttcatcctggttcttaatgataccatgaataaagtatagaaactctttagctgaggattaaagattgttgtgtttaggtagaccaggtttctgatgcagccctcagtataccagggaaattagccattactgtttgccttgtaggtctaatgaaccctttagctttttattttgtatatgtctaagttactctacaaattcttatggaagtataaagagatagtgaaagacaatcttatgagaaattttaataagaattgaaatacaggctgggcacagtggctcactcctgtaattccagcactttgggaggctgaagcgatggatcacctgaggtcaggagttcgaaaccagcctggctaacatggtgaagccccatctctactaaaaatacaaaaaaattagccaggcatggtggcgggcacctgtaatcccagctactcgggaggctgaggcaggagaattgcttgaacccgggaggcggaggttgcactgagccgagatcacgccattgcactctaacctgggcaacaagagtgaaactccatcgtaaataaataaataaataaataataaaaaagaaatacaacttactttttgtatcaaataaattttggtgcacaaacatcataaatgacataatatctgtcacacatcctttagcaaaacaggattgttaaaattcttacagctaatattatgtggtgaagttcttcctgttgaataattaagtggattaaaatatcatatttcctttctgtcattagaaatatattgtgcattaatcagtccttgggcctgagaacatttatctaggttttcatcatctgaaaactcacagtccaatatttcacctgtattatcaattcaccattatcattagagtttagaatgctgctgtctctttccatctatcttctgttgtatctaataattaggagatatatatatatatatatatatatatagagagagagagagagagagagagagagagagagtgagagagagagagagattggtaataatactaatatatataataatattatatatatacacacatacagagagagagagagagagagagagagagattgattttaagccattaactcatatgattgtgggagctgaaaagtcaaaaatctgtaaaatccaaaagcctggcaggatggagaccaagggaagagttgatgttgcaatcttgagtccaaaggtaatccgatagcagaattccttccttttctggggacttcagtcttttctcttaaggacttcaaaattgattggagaaggcccacccacattgtggagggtaatctgctttactcaaagtctgctgattgaaatgttaatcacatctaaaaaataccttcacagcaacatctagattggtgtttgaccaaacaactgggaaccatagcccagccaagttaacacataaaatttaccatcatcagccatcatcatgaggttcataatgtcatgtgtttcttcacatataaatctcgtggttcttttatttttttagtagtacctagttaataaggtacctggaaatatacgttaaataatagaaatggtctttaatatcttaatgaatttcagagttctatcagagtaattgtaacttgtatataaaaactgatatataaaaaacaagtatgttttttcttcctatacgttgtgttaaattaatactaattacctatcatgaaatgaatgttttccatttttcataaatgtatttcatttttaaattaagaggattaatatcaaaacatatttgaataggatttaaaatccaaattacctgttgcgattatatttaattataaatctttcaagtgagtttataataggaaaaatattttttattaaagtgatgtaccataattatgaacataaatagtgttttctactaattgtttttgtcttcattatgtttctttttaaggggaaagatctgggttaacaaatgttttattcatccaccttgaaaattaaacataataaacaaaactattaaataaataaaccaattaaagaaaatagtttttcttccttttttgtgataaagatgattatgagtaaatatattaaagaattttatactcagacaaagtgagctaataagacaaatacaaacagagatgagcccagaaagagatactctacatgtttataggctagcatttttatcttatgacctacagggtcattgtaactaaagtcttgaatttctgttatattttggtacctgtgggcataaataggaatattactccctgatggcatcatgcattttagataaaactaagccaagggttaaacacgtgccatggactgttcctaaaaaatgctctcagctctcaagttatagaaaattgtagggattattattttgtacctactacttctttctttaccaaaatttacttatacatgatttgaaaattgcttgccacctgtctttattctgttgtacttgtcttaagtaaaacatttataaagtaagtaggaaggattaatagattgtgacctttctacatgaaaaggggaaagccgagcttgttctacttttgtcaggaaagagtttgaatagttacctgttactgtaaaacaatcaccccaaacttagtgtcctaaagtagcaataatcatttattatcactcataggttctgtaggtcaggattcatgcattgcttggttgaggggttctgtctcacgatcactcatgatgttgcactcagatgtcaattaggctgcagtcatatgatggcttgactggggctgaaggattcactttcacagtgagttacttgtatagcttgtgagttggtgctgtctagttggtttccctctaaacgagttcctccatgggactacttgagtgttcttatgatgtggtggctggcttaccccaggacaagcaacctatgagttttgccctgagttttctgaaacatgatcccatgttgctttgaatatccccattagacactcccacaaatgtcaatcatactctttgccctaaaagttgcagactacttgtacatgtcctttatcctacatgtgtacaggaaacacgtgcagaataacatgtgtttttgtttcttgaaagaaacaagaacccaccaaaactttatagctccgggacatgatgataattatctcaggtccactcagcctggctccacatggaaaatatgggtattgtaaagaaagcttttgaattttggaggcctaacaaaaagacctaggaagctaatagttggttatgagataattataacaatggtgatgaaagcaattgcgattattacttttatgttagtgagataaatacataagaatgtccttctttaatttcattccttaatttccttaatccccattcttgatttctggattagaggaaagctatactatctacctgattacacaaaaagactggactgaggggtaaccattaggactcttgttagttgaaggtaataaactatattacttcagtggctaaaacaaacaggagcttttttctcatataaaactagaagtcaggaaacaaatggttgctgatgttggtttatccgtttgacaggttctacctttatcctggagattctttggcctttatttctttagtaatatagtagtaacagcactgaatctaaaataagagcacttggtccaagcactggctctgcccccttagtgacagtgggacccatggcaaattatttaatctctccaacagttaattttctcatctgtaaaactgggatcctgataacttccatactagtttggtgttaggattcaatgaaatgacgcatggaaaagtccttttcaaatggctactcactatacaaatattaatgtcttagtaagctcaggctgctataaaataatgccatagactgggtggcttaaacaacaggcagttgtttttcacggttctggaggttgagaagtacaagatcatggtgctgacagatgtggttcctggtgagaaccttcttcttgctgtatcctcgtatgttggggagagaggtggtgcagagaggtactctagtctctcttcttgctcttcttaaaaggacactaatccaattatggaggcctcaacctatgacctcatctaacccttattatttctcaaaggccccacctccaaatatccattgggggttagcacttcaacatacaaattttagccggcgggggggatgccagcattcagtccataacaatcaactatcctcattattgagagttccactaggccttctcaagggttgacaatgatagtgccctgctagctataagagtaaaaaaattttcacatctagaaaatgggtgcacgaatattggtaactgttctaatgtctatgcacagaatttttagaacttgctcgagaaatttgtctttcctgacagtgttgcttctcttaaattccagtcgagggccttgaaaaaaataggttttccatcaagattctctgaatgaataaatgaaatgctctgatattttctttcaatattaagataaagcaaaatgtatacagaattttctattttcagtgtttccaattactgcatggtttggcttattaccatctctaagtctaaccctgggtcataggagtaaagccattgggggtcccctacaaaggatacaaggcagtggtagatacaataagcctgacaattggagtcagatttttctctttcatacaggaaccatggaactgttgccctgggccacagctggctctcagaaaaacgtagaactggtcgaggaaaggaaaggcagggagtccttgattcacttgttatcagaaaattgtctgttcaaacaacagaatgtttgaaaagataaaatcaagtctcaaatgcacagaataagaatgaggggaaaacacctttctctgtaattaaacagaaaagtgtgccatgaagtgataaaacccagtcaacctgaaaatgtgaacatcaagtgtaattgtgcagaacgataaggtaatatgaacagcacaggaatatataggctcacgttggcattttaaagcaatggcactttacctgttcctcatgaaggatttggtttagtctaatcccttgtaggagccactaagaggagaaggcacagtccttttgggatgtaaaatggggaattctttctatgattacaagaatttgtaaattgctcagagttttaggacagcaggttatgtgtctctcaatgttgggtaccatgccaaacgtactttaagagacatagcaataaatagaatgggattcatttttttcttaatgtctggcagggcaaccaaaatgcccacgtttcccttcagtagcttggtattttggtaactaaaaacatgttccagggaactccagaatatgaaacatttcagacaatttgaaactgtcaaaattttcacttctttatgggacaaataaaatctaactttattcagattttaaagtatctcataaaagagtaatactttagatttgtgctgtgctttatacgaattggatgaggaactcttatacatatataagtggattttattttcacaacagtccctatggtagatattgtccttattaagtaaatgagagaaccaactatcaaagatattaatattttgcataagatcacacagatagcggaaccaggatttaatccaactcctctgattctaaaaataggtgttagatgggtattctttccccaaacctatgctgaaaggaggctacatttggagtcagttattgaaagtttaaatatatgtgtatatatatatatatatgtgtgtgtgtgtgtgtgtgtgtgtgtgtgtattcttatatactcatgcatgtagatagttataaagtacatgcttatatgtcaattttatatatacgactgatatataaactatcaatttgtgatagtttatttcaattaagttcaaacatattgggtatttattgactcatgggacttaaaatttctcagaggcattaatttctatgcctttaagcaaaataatgtttagcccgttttagaaagataaaaggctaacatatgttttgtttttgtttgttttgttttgttttgttttgttttgttgagatggagttttgctcttgttgcccaggctggagtgcaatggtgcgatcttggctcacagcaacctccgcctcctgggttcaagcgattctcctgcctcagccatctgagtagctgggattacagacacgtgccaccatgcccggctaattttgtatttttagtagagacagagtttctccatgttggtcaggctggtctcgagctcccaacctcaggtgatccacccgcctcggcctcccaaagtgctgggattacaggcgtgagccacggctcctggccgctaacacatgtttttaaaaaataaacaccattcgagtaggaaaagtgggagaactggtggttcagctagagatacggagatgggagggcaagttgctttctcatgttgccacatctgtaagttacaaatgccatagattaggaatttcaacgttgttgtgtctctctgaggacattctccatgtagtatatgtttcgcctccctgatggacagtaagcatcaaacggttactcctttatatttgaattattttaattctaacatcttgttctgaaaataacgggaatgccataaatacttactgattgattggactgtctcgcaggggagctggcagctagtgtaggctacaagctgccatcatcatctccatgaccatgagtcatcactggaattaccctaaagaggttaataaaacgccttgtttgaaaagcaaacaaaaagccagaagaaacccaaagcaaacagacccagactttgcaatgggtagtgaattttcagtcttaagggattgagagtccttttagtacaatctctcataaacatataacagattttaaaagcaccttggtctgattccagttcacatacctcatccttgcagaatacaacatactaggccatttgaaatgttcctcagtttacttttggaggatctgctgatttgagcaaaatggaaatgaaatgtatatagaaagctcttaatttttttttttttttttttttgagacggagtttcgctctgtcgcccaggctggagtgcagtggcgggatctcggctcactgcaagctccgcctcccgggttcacgccattctcctgcctcagcctcccgtgtagctgggactacaggcgcgcgccaccatgcccggctaatttttgtatttttagtagagacggggtttcaccgtgttagccaggatggtctcgatctcctgacctcgtgatccgcccgtctcggcctcccaaagtgctgggattacaggcgtgagccaccgcgcccggccagctcttaatcttaagaagttcagtttcgcagctccccccccaccaacccccaatcttgaaagcaggaatttggattagggttttttaataaaactttctttttcttattaccatgatgttttttgagagggtacagagaactcattaaaatgttatgttataacttaagacaaaatgggaatgagaatttgcattatataaacaaagtgtatgactaagtaacctgttacatataaagtgtttgactaagtaacctgttgtccctaggagaagtagaataaatatcaacatgtggcaactaacagaatgtgttgtgatcactaaagcagcacattcattgactttacacttcattaagtaggtaacgaattttacaaattttaggacttaaccaggctgtccataatactttgcatcagtaagtaccaaaatctacgatagggcacttcggagttccttaatttaataatattgataatattttgtttacattttgatttaattgtatcatttcattatttttgtgtcctgattctaaatatatacgtcaacaagctatatggccattcaaaacaggtaaactttaaatatgtttttgacatagaaattatgtaacagtcttcatcatgagtataggagtcagatttccaattgaaaatttcatcctctaaaatacttggcatatgtatacagttgtctagttcagacaaaaaagtattgaatataaagttgattttgtaaaaccagaattggcatccttaaggaatacaaataaagggaatcttaagataatataataatgctgatttgaaatgaaaattaataaaattgttattctattttagtatgctaaattggacagatccttatttcattgaaaaattagattcttcagtatatcagtgcactgtgctaataacacaagaagattaaattatgtccatatgtgatttggtagaatttaattataaatataataaatccttcaatatgtacagcagtgaatattccaaatttatctctcatataagttgtgagcaacttaaggataggcaccatcccttaacatacctagattaagaacagtacctagaaaacagtcatcaaatgcttcctaaataaattttcaccttcaagcttatggcagcaaattaaacatagattgacccttttctaatagagacagaatagatgagactgatgacttttttttataaatgtgtaagtctgcaaatatttagtaaggatctaatttacacaaagaaatcaacctagagtgagattattttattcatttcccggaggctgtgactgaattatatttgcaacttgccctaatttttatacttaataatttgcattagtatttaaattatgtgaaggaaaaatataagtttaaaatactgaaaagtatattcacacattcatcaaatgttgattatgtgcttacagtgtgcaaggtattggggctaggaattatgtggtgttccaaggaaaccatgatacagcctctttcattacagtgtttattattaggtagaaaaagtaaaattagtataatattagataggatatatgtgtcataggagtaatataaacaatattttatgaacaatgtatgaaggtataattttgttcatttatccatttatcgctctgtacatccatccgtttattcattgttcattacttcatttaataatactttagtgaccattggaaaagggatttataaaagtgagtaaaatgttaatcattttctaaagaagttgataatctagggaaagacaaatgtgtaccaacaataacttggatataaagcataaattagaggtacaagcaaagaaaaatgaaagtacaaaggagaaaaatatttggctgcatgagagcagggactgtgtcttgtttcatcatagattttccagaacctagatcagtgtttggcacaaagtaggttcagatgagtttgtgttgactgactgtctactgaagtaattgtggaacatatcatagaagaagtagatcagaggctggatcttaaaactgggagaaatacatttcagctccgtgaaaccccagaagtgatatttgacattagaaagcacaaagtcacactctaacagtgacagtactgagtgaagtaagaattttctgcaccccttcttcttcttccactcccattaacccttgttagggtgagaaatagcagctggtgaatggtagagaagactagcaagacagaaagaggaagcccaccatgcccactaccccaggtagtaaaggacctgtccacttccatcctcttctaattgaggaagaaatcatatatgtgagttcagattgaagtattgattaatatattgagctggatattctaattttaatgtctcgatatggagcaggactttgtttccttaatgatgaccagaaaagacatgaaacttacccatattttcacccaagaacagaacagaacaacctacttgaacagatttaaagggagaaccaaaggcagataaagttgtctttattcttacacagcataagtcctgattattcatcaatttatacattttatgaatttaagaaaaaaggaaaggaagactataaagggattcatatcaggatacacatgaaggtaatgtagtcagttttttagtggaaccaaaatattacagtcatcactgaacgaaaatattacaatcattacatcattcactagattaagtgaataaattaaaaatatattaaataaaattaacaaagacatgagcttttcaaagtgtgtggtaacctggagcaataagcagtgtagttggaatgttacctcttaaggattatcaaagaggctggctgttcagtaggacagtggtatggtaaagcaagcttgctacattgcagaactccagagggcaacattctaattatctttagctatggggtctgttcccataggataactataacttagtaggttgacagagcctcccaagaaaccacagcagtgctcaattgtggcgaattacttctctatcccatcaaaatgtcgtgattggacccacaactgtgcatacatttttttggcattttcctgccagaagcatatttacatttctttaatatccagtcatatccttcccttatttaaaaataattattcagagaattccagttttttgtaatcctctcttctatgaattttagcaacacttatatacagatacttgatattctggagaaatatgcttcaagaccatgtggattaacagattttcaaatgccgttatagtatatgtatatactatatatgtataagtatgtgtagtccccaaaatgcgtactttaaaatcctcataatagatctcttacagatgaggaaaagaagatgtagaaaggttacataaagtagctaacaagtattccaaataatattgaacttcagtctgactattccaaaattgcattcttaactctgatttctatatttgttttccattctaaactgtgtattgtgatataagttcctcactaaggctctttttcagggtcttcctaatactaaagtcactcttacaatgagtattttctttacgtgtgaaatccaataggcaaaaaaaaaaacttggcaataaattttaggcattaacctcatgccaagtaattatcagaaggctgtaatgctttgaaacttcacaagtctgattttaagataatggaatgaggcttgcattgtgaactttcttgatgctttacattgcaatatgctgtatagattgacttcctaaaaataaaaaataaaaaaaaagatttgtagagcatactgggaaggtcttgccaattaaaaaccggagattggctgaaggcttgcagcaattgaattttgaatacagatggtgtcaaatcgagtgtttccatagcaacagactcttccttaataacttttagatgggagggggtacataaaagagaaaaccatcttttagcagatgtatgttttcagcatgttttcagattgattttggaagctaatttgtacttaactagtgattgttttaagtggatctaaatattactaaattctcctgaggaaacattttgagaataacagaaataaactctaggaactttataaagacatgaaaagggcacaattttacaaaacctttttttttttggtctggagccaatcaaacagtattttatattgagtatgacctatcaatagtcaaagagttcttgattcttaatgcctgttaatattgaatgtttagaatatgggtaaaatcaaggaaaaagtgctatgtatctcatggatttggaatatcttaatatactctttcttcaggttaatgattatttttaaaaaatgatgatataaatcatttcaggaaggactgcataaagaggtcattgatagagttcatatcatatagcagagttgtcgtagatttaatgtccaatcctcagttttgcatagccaacaactaaattttagtagtttacctagagatgatcaggctctgggagactgattcatgctacacaaactcacaaggcactggtttataaaccatttgaaagaagaaataataattcaaactattattttacaacaagactggcaggaaaatcaataatggtaatgtgttcggggtgtcctccccagtgaggactatccagaagaccaaatgatagattattgttcaaagtgatagaattgggagaagggtaataaagcattatgaaaggatgcttccttaagtgagaaaagctacataaactacccatctttactattctagatgaccttaaaaatattaatagaaacagagaaacagacaattcatctcagatggtacaaaaaacataatagcacatgtttgctccctggcttccttttagattccctgcaagaggttttcccccaaccaccaccatatacagatatacagctttaccttcactctcctattatctgtcacagaacaatataaaactcagatatgttagtataagttaatagttggtagctttatgttaatgacattgctacctgttacccccagattcatctgggttacttcatccccaaaaccctttcaaaacgacatttcccacaaagatttctagtattactggccattcccggacatcttgcttccaacataagaaattctgacataatagggatataagaaggccttgggaatctgtatttataacaagctccccaggctatctgaggctcagccagtttatttttgcagatagctattactatccacaatctcttttatcctattgtaattgcagaagaaaatctttctttctagtttctttgaaatttctggaatgttaggacttagagcctctaggaacttgtacataaaaagagagacttaaagagatatcaaagtagagatagagatagatacagataagtgcatagacatagaagtagacatatataatagaaacatatatgtatacatagaaatagaaatatgccatttagaactcttaagaaatatgtgcactcttaaaatatagtttaaaaatgtaaagaacttgctattaattgaaaatagcataataaacttaaatgaaataaggaccccaaacgcaaatatttctctctgacacaccacacacacacacacacacacacacacacacagacagagagagagagagagagagagagagctgtacaataacaaccaattcctgacccagataaagaaaaaatttttatttatcttctttctcattctattattattttttctagattaaattaaaatggtaattatgtgtaagaacaagcattattgccatataaacaatgcaacaaaggaatcaattgaaaattaagtgaaaataaaaggtacagcttcgttaaagacccagttcttagagcttagtctcaaactctttgtactctgcactcttttcttgatttgactcgattgattgattgattgattgattgagtcagagtctcactctgtcacccaggctagagtgtagtggctcaatctcggctcactgcaacctccacctcctgtttcgagtgattctcctgcctcagcctcctgagtagctgagactacagacatgtaccaccatgcccagctaatttttgtatttttagtagagatgggacttcaccatgttggtcaggctggtcctgaactcctgaattcaagtgatctgtctgccttgttcccccaaagagctgggattacaggtgtgagccaccacgcccagccgattttactctctttagaactgcaaaagtaggaatctagctcatatgcagacattctagaaagtttgatttcaaaagtcttctcaaaagaaagagagcaagagcaagaaagaaagcagagagagaaagcagaagataaaatggcattgtttgaacagggatggaaactgagtaagaaatttggtcactaaacactttagtgtctatcatttaagattgtaatttggttatttatcactggaaagtgattaataatctaaaatgcattttataatactaatactattaaaacattaatttttggagaaagtttattatagattgatttatacttaccactgaatattaaaatgtttaatggaagtagtttcaaatagtatttaatgatatagggaattattacaacattaatgctcaggaaaaaaagtaggatatggaattatttatgccataggatcctaattttgtaaaaaacagagaaaaccagcaaaagaaattataactggaaggaaatacatcaaagtggtttgcagttatcactcatgaaattgaggtgaacttgatttttttccttttatatccatccgtgttttaataccacagacatgctttagatctgcccgtatattgtggctttcagagggtaataaaccattgtgactcagaaatagctaagaatttttatctctcaagaacaaattttcactcccttggggtgtcattatctgttgagaatgcatgcaatagttcaagagccaaaagactctgattcagtaagtttagggtagaaaaaaattaagtacatttttaaaatagagctctggtgtttcaaaggcaatgtgcaaatatacctacttaatattattctaattttttcaggatagctgaaatataaacatctatttttagtaataacacaaatgatggaatgcttttacatatttataaatcattaaggatttgctttttgtttctactgtctggaacatataaatttgaacacaatttagaacaacattcaggaaatatgatttatttattaccttcttgacctttattttatttttaccatctacttttatgtaagtcttttttttcaatcattgtttatttctttacttttccttccacatagaattaaagggagattcgggcttagtgtccttaattcatagttccattgtggctattaaaaggtgaactgaaagcttgcaaacacgtggtaccttgtagataattttctccagtcagacagttagataaaggcctctgaggtttctggggtcattgttgaagctatgttttaaaatcctatatccttctctcattgttggttccttttcacaacacagaagttttcttttttttaatttcaacttttagatacagaaggtgcatgtgcagatttgtcacgtgggagtattgcatgatgctgaggtttggagtacggatcccatcgccatgttagtgagcatagtaactgataggtcgtttttttaacccactcccctccctcctccctctagtagtccccagggtctattgttcccgtatttatgtccatgtgtgctcagtgcttagctcccacttataagtaagtgagaacatgtgatatttggtagaacttttcatttttaagttaaaaaacaaaacaaaatgaggatgagtggaagaactattcagcacagcaggttataaaccaattaggatgatgacgccctgaatggagattttcatgaacatctcatattagctatttcagctttggtttttttaatgttcaaagtaaatagaataatgaagaggctatttaggaaggtttagactgagggaaaaaaatcctttcattaggttccaaataacggttagcttattaaacagcaagaggcagagatttagcagagaaaaaataaaaagatttaaaaaaaaacaacgagattaaaaggtcagtaataccattggaactggcagcatggcaagtttatatcagctatcttttgttttggaacacaactatgctaattctgttctgaacctcttgctaatgcctgtctcaagaaaatttaacatactttatctgtgtgtacaaaaatacctaaggacaaagctattacccaaactgtattcagattgaaagaatccatatagaaatttgcagctaacgtattagtcagtgtatgtaatttctactgcttcacagcacaactctttctaattttcaggagcaatatagcaactgcttgccagccaagagaaaaccataggagcattcttatcattggagccaacattagttctgcctacagtgactaacatagatgcgtttattgctagctggaattttccattggcactagttacatgtaataagttagtgctttcaaatggaccgtggaatataggaaaactagagtctgacgtaaccaaaaaaaaatgttgataaactcagagattatgaaagagaggagaggagtggtttttgtggaaatgatagaaaagcaaaaaaagatggcaggatttggaaaaaagaaaatcaggttagagatttaattagtaaaggagctccttttaataattatataagagtatgagtttagagtaactgcctggctaatatgtacaatcttcaagttcagtcgttttccaaaattctaacttttagcattttttttttgtaaattttaagtggaaatcttccacttttgttgactaacttggctacctgatattttactcaacctcctactttcttgttctctacttcttctgagtctttgcttccacaatgaggtagctcatattccttaagtttcctgtctggttttgcttttttttttttttttaacagctaaaataaactctacaagcatttctatcattttctttacatccaatctcttgtcagccatgtcctaatcactttggtaaagtatcagtgaccacccaagaggttcactttgcttcgtcaaaggaccacctgtcatgctttatctccagagcttctgccttgaaagtaagaataatataacctttcctgaatgtcttatttcaatttcatgcatttgatctgcctcttcagaccattcccaaggctttgcccttgttctttaccctcatggcttcagttattcatcactatatgaatgacagctctcaaactgacagctctggcctctcacctatttcatctattccatatggcaaactgtctatattacatttcatcatgagggataattataattccacattcaacaagaaattgtgggtccgtgttgatttccaacagcaacctttattttttagactatgatagagaaagggtcaactttctctcttacttatttatctcaaataactcaaagtcaagctagaaaagccaagcaagtaatatttcccaacaaagcagctttaagcaaaatgattttcagacacgacatgcagcctgtattgtggaagaagcacagtgacctaggtgtactttgctgaaaagcagtggtcacagtccattagtttcatctttttcctgcaagagagaaaagtatggcagggccaagactcctaagaccccttaaaaaattgtgaggtttttataaccctgttcatttcccatcaaaagcattcatgaagcacctgccatgtaccagatgatgcattctaggcagagggaagaacttgggcaaagtcctgtacattttatcttctaaatcttactaatcttttcttatctttccatctaccacccaccatcaggctgtgcctggactcctatgctaacatcttactctgtttttctgcatcttttttgccctcccctccaatctactctccaattagcaacatgactaatgttttcaagcccagattagacggtgtcacttccctgctttaaacctttcagtggattcccattgcactgaggttgaagaccaaaatctttaccataactcacaaggccactgggagctatgaaaattttcttttttagtttttccttttaattagtgatgcattcaataagtggagtctatcgtgaaagcatagattccaaaggcatgtgaatactcaattatgtaatttacttacagaatgtttattacttcttttttagctttgattttgtatacatcctaactcaatctcagttatataagagattataaaaaagtttgtgatgaatgcatacataaaggaacaaataattaacaaatatataaagacaaatcagtattgaatgaccaaatggctctttatttattaaagaacttagaaaaatatagtcttgcttgagaccaagttctggcaacgtatgtgtgtctttttgtttgggttaaaaagcattagttttatatgttttaaaaggataggatcttcccttggctgcaaatagtataggcaaaatgctattctgtatcttattttaaagaaaataacaatcataccttattatttgctgacagttttgcagtttacaaagcactgttcacatggattaccttattttaaattcctcaattttttttccttttactatgggaattctgtttcaggagaatttccctttaaaattaaggtgattatactattctgttcctgtatttcgtagccatatgtttcaccaaggtattgtctctctccaggtctttcttctctggatgtatagttatgattttccaggaggtaaatgaaaacagtgggagcaattgacagagtgttttttgtttcccataaacccaagcattgcatttaaggagctgctgtactattgtaagagttcctatactaattttaaaagttcatttacatattttgtagatttttaggataagtcatcagaaaaaaattaaaaataaatttacatattttgtattaagctgttttgttacttgaatggggattattggaacgaggaaagaattacttttatctccccatttttcaaatcatttactataacattcatgaattgctgaagtttaaacaatcaaaaatatctgaaaatggagcctaggaagggtaacttatgtctttcatactccttcctttttggtttttctaccagcattttagtctaaaatatattttattttcactgatcctgtgtttgtcttaataatatagtatgtatgttaaatgaaccagaattcattgatctttttttttattattcctctttttgcttttctggagaagcatttgaagaaatcagttcaggctacacttcatcaattcatttcctcatcttccccttaatacaaaagccccattttcactcttcaaaacatttgatcacatacttaattttcatagcattgactaaatgtatgtgtttattttgtttatatattgcatatttgtgatgattttcacttttacagtttaggcatgggtaggaaggacacttacatgagtacttaagttcttggttatgacttgagaaactcacaaggtagcatggaatggcacgtaaacaaggctttgatagggtgaaagggaattatcaggacaaaactgactagtggcagtgacttttgagcagagtgctgcaaactgaaaaggcagagagcattgtaggcagagagaaagcatagacacatgtgagatacatgtgaaatacttagacaaatgtgaggtgtgtggtaacattgtacatacctagggctccttcctgtgtagctgtaaagctggagtataggcatcacaacaggcagcagaagccaagaaactagaaaagtagacaaaggccacgttataaaagatcttgtaggataggtaaagagttttaatactatcctgaaagcagtgtggggtgggaggcatgacattaaggaaatttaataagtgatgaaagaccaagattttcatcttcagaagacttctctggaggtgggtggaccacttgatgtcaggagttcaagaccagcctggtcaacttgatgaaaccccatctctactaaaaatacaaaaaaatagctgggcatggtggtgcatgcctgtaatcccagctactcaggaggctgaggcaggagaatagcttgaacccaagaggcagaggtggcagtgagccaagatggtgccactgcacttcagcctggatgacagagggagactccctattaaaaaaaaaaaaaaaaaagacttctctgactagagttttaaagaaggatggggagtgcaaaaggctaacattaaatcagtggttctcatccctggctgcacgttagaatcactagggggagtttaaaaaaaatgccaatacttggactccaccccaaaccagttaaatcagagccttaatagggcccagacattcgtagtttttaaagcagccctcttgattcaaatgcacagacaaggttgtgttccgctgaactagagagaccatcaggaggcttttaactaaagcaatctagggaagagagagatgaatgatatagaggccagaagagctattaaggagaagtgactcggcatcttcttggttaaagtataaggaagaaagaagaatgaaggataatttgcatgtttctccttcagtgactaagtagaggaacagatgtgtatcagtgattaggggagaggaagaatgaagatgatgtaatccagtttggatatgttggctatttcatagagatttagtaggcgtttggctctatggatacagagttcaagagacaattcttagcttaaaacacagattttactctgattattttagagatagtaaatgaagcaatatacatacatgaactcaccagagagaatatgtaaagtgaaaacaaaaagatcaaagggagacccctagggaatagcaacatttaaggaatgggcctaagagagtgaggagtggccaaataggcagaataaaatccaagaaggaatcttccatattaatcaaaagagaaggtttcaaagagggttcgtcaattggcaggtactgaagggatatctgaaaacataaagactttagactctctaatactgtagcaactttaaggtcactgctatcacctacaaaagtaatttcagtggcaaaagccaaaacgtaatggtttagaagggtatgtgaggtgtggatgtggaaatagtgggtatagactattgcttctcaaaatgtaatcacctgaaaaatcttattttaaaatgcagattttgattcattagctctagagtggagcctgagattctgcatttctaacaagttatcaggtgatgctgatgctgctcatacacaaaccatcctttaagtagcactggtgtaagccactctcccacaaaggaggaagacatagggtttccatcaggggacgcaggtggggtgtaggaccaaaggaaataatactcttttgtcttttgtttggttggttttggttgttttcttcttaaaataaacatggttgtagacggagattgaagacataggaggggtaaaagatggaatcacttctcatagaagatggaagagactggaacattgagtacagcgagggaattaggcatgggtaggagggacacctaaatctgaagagaaggaggtaaggaagaattgaaatacagaaaagttctgtcagtaagcaatgtatggaattgtgctttttagccatagtttctgttcaagaaattgttttccatttatttttatttcttaacttgaatagttggatggtggagtatgcttgtaaaaataagagtgaggccactttgtttttcggggttaatttccgttttctgcactcatcaagtaaaagttgaagtggcaaggtgtagatatgaaattcagtgtgtgctaagggagaaaaaaatgctttttattctacatgattttaaaaatatttatattccaacaaatgcatcaaatttgatgtgcaaatttacagtgatgaatgagttttattgtgtgcattgcatgctggtgacatggtaataaatctgtggtgctagaattataatggtcccctttagcttcgctttaatgaactcttgctgaacacttttgagttgttagtactttatttgctacatttggcacttaattagttaatgactgagatgctggaccgatggatcatctaatgatatgttaggcctattatcacatctagatagtttcttttctgtgacttgtaagtgacctaagatgataaactgaaatatttttgcatagatatacatcaagcttttctcctaacttcaggctttcatcttaagcaatagtttccaacacccccaaaagagaagtcattatgtttttaaaaaaattattcattttaatgtgatcaaataatatcacatttcagcattcacctatttaattaataaaacaacttacatgtttcattatgactggatgttgatattttttcataatctattatcctccaaccagtggtaaaaacccaatcctcctctcacccagctcatctttccgtatgggaagcaatacatacttccctatgttttattaccaaaacaggagaatgagctttctttagaaggttaactcattttctctattagaatattcagcatacttttaaggaggtaatctggtctttgacagtctgttgattagaaaattaagagacctgcctaaattccatttccaactcctctccatacacattgtgactttgagcaaaacgttttgccatttccactcgtataagttctgtttagtatctttaaacttccatatcccacagatggtatttttttcttcattggaaagtggtgttagtgattcagaaaactgcttaaataatacactgctttgtgttttctgtgagagaatttttttttttttttgagacagagtctcactatgttgcctaggctggagtgcagtggcgcaatctcggctcactgcaacctctgccgcccgggttcaagcgattctcctgcctcagcctcccgagtagctgggattacaggtgcctgccactgcgcctggctaatttttgtatttttagtacagacagggtttcaccatcttggccaggttgatcttaagctcctgatctcatgatccgttcacctcggcctcccaaagtgctgggattacaggtgtgagccaccgtgcccagccgagagaacattttatctaacattctattttaaaatttttcaaatacacagaaagctgaaagaattgtacagtgagtgctcatgaacccactctctagattttgttgtatcactttacttctttctctacccgccaacccctattattttctgatgcccttcaaagtaagttggtgacatcggttccctttacccctaagttcttcaacatgcatgtcattaaccagagctcaatatttgttcacatttcttttgtttgtttgtttgtggcaaaatttgtatagactagaatgtgtaaatctcatgtgtattatgaaatgagttttgatgaatgggtatacctgtgtgacacatgcctctcttaagatacaaaaaaatagccttggcccagacaggagggaacattttttaggttggcttgagtttcctttaactgacatgtagcatgactgaatatatgaccataagattgccaagttgaaatttaccaaaggtccatccaggggaacagtatggctattgatacgtcatttgttcatctaggcactgggctgggtgagttcttcacaaaaaccttgtaaggtgagctttcagctctgacagaggcatcaagaaacgtatttcacaaactgttagagctgaaaacatctccagggatcatccaatctatcctcctttgctttatgactcaggatttaagaagccccagaaaagtccaacagtgttaccaaagtacacgattgcctatttacgcccctataattgagagctgtctaggggtcaggtacttttctcagtgccttgtgtacattatttccttttatctttctagattattaattttcttgttattatccccatataatagaggagtaaacagtgtgaaaatagcactaaactgttgatcttttccatgttccaaactaaccttaaatgttaggctaatattataaaattttaaaatttagtcatttgttctgggtctggcttccatgaacttaaccaaaatgcttggctgtttctgcattctagctttttgggatttagagaaaaagcaacttggtcatcatagtggccaggatttatttatgtgccaataactcccctctgtttttagctttttgatctgttacatctcagatactttattctctatttgtaaaacaaccacattcctccttttctatatctaagtgaaaaaaaatgcccgttcatactagctacatggttagcatatatgtttcttcctctttgtgggtttgagttgaaacttcttttgcaaagcttaactatagataggtcttccacagaaccctgtttaaatgccttgtggaagtagaagggacatatcttaatattccttataatctgtgttattatttggactttcctcagttccttatatgtctttgtatgtcaaacattgagttatgcttacattactctaggtatagttgtgtcctagctttgtacaaggttacaataatggtggtttccttgttttcagcttcattcttgatcatgcctaacattttttgatggttttagcctcggagaacagtctactgctatttctccctttttcctgatcccaacaaatagtttagaaatctttgtcttaactgcaattgggatcatttttcctttagagttgcccacagttagtcatgtccgtcactcttcactcactcaaatgacctcaaaagatttacctgcaatttaagcctttcaccttggcattttctacctggaactctggcgtactctgtgggatcagtgagatccatagtgtgcactccctagcagatcgtgaatgtttgttgataactataattcattgtttagtcttgtctatacagagaagcagtagcaccttgctttagtaggatcctttatgcttttattcattattgaattttatcttcacaataattctgtggttctgcagttgtcattatttcagtttgggagttgaggaaactgagatcgtggcaaatcaacttttcccatttaaatccactatttcatcgctaatccagggttataacccaagactaactgctagtcaaagttgctttctaaaaatcagttacacagacttctaattctcgtgctgtacagtcagtgcagaaattgcaacagaactgttctttgttctgtagcaatgtgtattcaaaaggtaatcatttcttgtgtataaataacattcctccctaagagagatgttgtgggaatttatatcagtcaagaatgtatatcgataattaaacatagctagtctaaaaaacttgaagtgaaagattggttcgtattcaatcaactgaactgtttctttctctgcaatattgtggttcttgacatgattgctgagtttccaatttgacacttctggaggttcgtaaatcaggacacatgctgggtctcagtctgtcatcctgagtcttagcattggttatttatttccctttattacccaacatctatttactgcacaaattagtcgagaagctttccatgacggacctttgtgagaaaaaaaaaatgtgtacattgggtagctcttcaattacaaacatgcacagattgtctgggtttatgtgcatatactttattattatttcacttttgtatgtcagatgaatttggtgtaaatgtaaatctaacaatatgggctctagtggccaaatacattgccataatatgtttttgatctgtcagtctcctgggtgaagtgtcgcaagtgtggtaaaattctgtagtataaattgatgctcagttatggacaattaccaggtctatatgatgtcagactaccacactgatccacttttaggataacagcttcgctctgatgatcttcagattttagatttgctttcattccttgacaaaatgaaatacatttaaaacttctaaaattgtcttttgtatatatttctgcagggtctactcttgggactactataacaatcaattgtactgctttgtttcttttattaaatagcagaatagctgcttgattcgtctgtatgtgctgatgtgtgtctgtgaatctagtccagttcactgtccaataagaatttctgaaatgttctttgtcacatcaatgtacagtcaaaatcgtattgtgtttgtagcagaatgattgcatcttttattattcacagcagccaaaatgacacatatttcacacgtgacaccttttttaaaaaagatgaattgtccaaagttgtatgtagaatatatttcacaaatcaaattccctatttaataaatggtgctgggagaactggctagccatatgcagaagagtgaatttctataaatagaatgcaactgtgtaaatagcatccaaatcaagaaacataatataatatagccagaagctcaggatcccccttcatgtcttctccagtcatgaacatttcacaagggtgactactatccttacttcaaaagttttctattactttttcctgtttttgtgtattatatgaaggaatcgaacagtcatatctacttgtctgtggctgtatttttccccccaacaatatgtttgtgagattcatccatattattgtatgtagttgtggattgttcacttttcttactgaataatattctattgataccacagtgtatttacacatgttgatatagatgagaaattgagtagtttccaacatgaggaaattgctgtcaacaattctgcaatccatagccatgctatcaacagtctagtacatggtttttggtgaatatattaataactatgcatttctgttggatatacacctgggagtggaattacaactcaaataatattcattttaaaaattttatttcgtttttagtcgacaactatattatggggtacattgtgatgtttcaatccatatatatacattgtggaataatcaaatcaggctaatagcatatctatcacctcaaatacttctcatttttgtggtgagaatatttaaaatcctcctttttagctatttggaaatatacaatatgacaatattagctatagttcctgtgctgtgcaaaagaacaccagaacttattcctcctgtctaactggaactttgtacccattgataaacgtctctcatttttccatccacccaccactgcagcttttgatcaccaccataatactctccatttctatgagttcaactttttttaaactgcacatacaaatgagattatatgatatgtgtctctctgtgccaagtttatttcacttaacctaatgtcctccaggctcatccttattattccaaatgacagaatttcctaggtttttaaaattttttttttatttttaattttttggggtacatagtaggtatatatatttacggggtacatgaggtgttttgatataggcatgtaatgtgaaacaagcacatcatggagaatgaggcatccatcctgtcaagcatttatcctttgtgctacaaacaatgtaattgtacttttagttattttttaatgtacaattaaattattattgactatagtccccctgttgcactatcaaatactaggtcttactcattctttctaactattttttgtagccgctaacaatccccacctatcccctacctccacactaccctttgtagcctctggtaaccatccttttattctgtctccatgagttcaatagttttaatttttagatcccacaaataagtgagaacatgcagtgattttcgttctgtgactggcttatttcatttaatgtaatgacctccagttccatccaagatgttgcaaatgacaggatataattcttttttattgctaaatagtaccgcatcatttatatgagccacattttctgtatccattcgcatgttgatggacagttagcttgcttccaaatcttgcctgttgtgaacagtgctacaacaatgtgagagtgcagatagctcttcaatacactccctccttttcttttgagtatgtacccagaagtgggatttctggaacatatggtcattctctttttattattttgagaaacattcatactgtctttatggaggccgttactaattcacaatactaccaatagtggataaggtttccttattctctgtatcctcatgaacacttgttatctttcaactttttgataatagccaatccaaaagatatgaggtgatatctcattgtgattttaatttgcattttttgatgattagagatgttgagtattatacatatatgtgtgtgtatatatatatatatatatatatatatatatatgctgtttgtcatcttttgagaatgtctattcatatatttgcccatttttttattagggttatttgttttcttgttattgagtagcttgagttccttgtatattttggatattagcaccttatctaatgtatgatttgcaaatatcttctcccaatctgtgggttgtctctttattccattaattgtttcctttgctgtgcaaagctttttagtttgatgcaatcttacttacctatttttgtgttgattgtgtttgggggtcatatgcaagaaaccactgcccagaccaatgtcatggagctcttctcttatgtttttgtagtttttagtttcaggtattacatttaaggctttaatccattttgagttgattcttgtataaggggtgagataagggtccagttttattctgtatgtgaacattcagttttcccaataccatttattgaagagactgtcctctccctattgtgtgttcttgctacctttgtcaaaaatcaattgatcaaaggtgtgtaggtttattttagtcctctttgtcttattccattggtctgtttttatgtacttgccatgctgttttgattattatagctttgtaatacattttgaaatccagtagtgacatacttccaattttattctttttagtaaagacagctttggctatccagggtcttttgtggttccatgcaaattttaggattttttaaaaaaaattctataaagaacaatatgcagattttgttagtattgtgtcgaatctttagattgctttatgtttaacaatattaatttttccaatttatgaacacagaaatctttccatttatttgtgtcatcttcaatttctttcgtcagtgtcttatagtttcaacacgcagatctttcactttcttggttaaattcactccaaatattttttcatgctattataagtgagattgtttccttaatttctattttagacagtttgttgttattgtacaaacaataacaattgttatcgctactgatttttgtaagttgattttgtaccctgcaactttactaaacttgtgtatgaattctaacagttttcagtggagtccttaggatttgctgtataagattatgtcatcagcaagaaggggcaattttacttcatccttttcagtttggttgccttttatttctttctcctgcctaattgctctggctaggactcccagtactaagttaaacaagggtggggagagtgggcatctttgtcttgctcctgatcttagagaaaagccttctacgttttactgttgtgcatgatgttagctgtgggcttgtaatttatggcttttattcttttggagaacatttcttctatacctaatttgctaagagtttttctcataaaaggatgttgaattttgtcaaatgctctttctgagtttattaaaatgatcatacggtttttgtacttcattctgttatatgttgaatcacatttattaatttgcatatattgaaacaaccttctatcccagggataaatccctcttggtcatggtgaataatccttctaataaactattaaatatggttcactagtatttcattgagaatttttgcatctaatttcattcgtgatattggcctatagttttctttccttgtagtgtctttgcctggctttgggatcagggtattgctggccttgtaaaataaatttggacgaatcccttcctctttagttttccaaaagagtttgagaaagatttgtgttaggtcttctttaaatgtttgtagaattctcccatgaagccatctggtcttgagctttcctttgatgtgagaacttttaaatactgatgcaatctccttaactctttccttagctgttactggtcttttcagatttccaattttcattattcagttttggtagattatgtatttctaagaattcatccatttctgttaggatgtccaatttcttggtatataattgttcatcgtagtctcttaggatcctttgtatttctgtgttatcagtcataatgtcttctctttgatttctgatttgatttatttgagcctgctctcttcattcttagtctagctaaggatttgtcaattgtgtttagcttttcaaaaaaccaacttttagttttattgactttttttctattgtttctctagtctctatttcatttatttctgctctgatctttgttattttcttctttctgctaactttgggcttaattcattcttctttttgtagtttcctgaggtataatgttaggtatttcatttgagatatttcttcttttttgatgtaggaatttattgatataaacttccctcttagcactgcttttgctacccccagaagtttttctatgttgtgttttcatttctgtttgtctcaagacttttaaaaaatttcctcttgaatttcttcttttgacccaataattgtttaggagcatattgtttagtttccacatatttcttaattttatatgatttctcatgtaattgatttctaattttatattgtggtcagaaaagatacacgatgggttttcttaaatttgttgagacttgtctgtggcctaacatatgatctatcctggagaatgttacatgtgtacttgagaagaatctgtattttcctactgttcagggcacaatgttctgtatatgtctgttaggtccatttggtctaaaatgtcattcaagtccaatgttttcttatgaatttttctgtctattgcttaaagtggaatattgaaattgcctgctattattatgttataggctatgtttcccttcagatcccttaatgtttgctttatatatttaggtgctctgatttgggatgcttatatacttgttatgtcctcttgatgaaataacctttatcaatatataatgatgttctttgtcactttgaacagatttgacctaaagattattttgtctgaagtaagtgtaactaccctgctctctttttgttctcatgtacatggagtatcttttttcatccctttactttcagtctatgcatgtcctttaaggtgaaatgagccacttgtaggcagcacatatttgggtcttgttttttgttgttgtcgttaatccactcaaccactctatgccttttgattggagagtttaatctatttacattcaaaataatgatggatgggtaaggacttactagtgtcattttgttcattgtttcctggttgtcttacagattctttgttcctttcttcctctattgctgtcttcctttgtgttttgatggttttgtgtagtagtatactttgggtcttttgtttttatcattcatgtatgtattataagtttgtgctttgtggatactccgaggcttacataaaacattttataagctgataataacttaaatttgattgtgtgcatatactcaacactttgactctccctcctcccacattttatgtttctaacatcacaacttacttttttttttaattatactttaagttctagggtacatgtgcacaacttgcaggtttgttacatatctatacatgtgccgtgttggtatgctccacccattaacttgtcatttacattaggtatatctcccaatgctatccctcccccgtcccctcaccccacgacaggccccggtgtgtgatgttccccttcctgcgtccaggtgttctcattgttcaattcccacctatgagtgagaacatgcggtgtttggttttctgtccttgtgatagtttgctgagaaagatgatttccagcttcatccatgtccctacaaaggatgtgaactcatccttttttatggttgcatagtattccatggtgtatatgtgccacattttcttaatccagtctatcattgatggacatttggattggttccaggtctttgctattgtgaatagtgcagcaataaacatacctgtgcatgtatctttacagcagcaggatttataatcctttgggtatatacccagtaatgggatagctgggtcaaatggtatttctagttctagatccctgaggaatcgccacactgacttccacaatggttgaactagtttacagtctcactaacagtgtaaagtgttcctatttctccacatcctctccagcacctgttgtttcctgactttttaatgattgccattctaactggtgtgagatggtatctcattgtggttttgatttgcgtttctctgatggccagtgatgatgagcattttttcatgtgtcttttggctgcataaatgtcttcttttgagaagtgtctgttcatatccttcgcccactttttgatggggttgtttgttttttcttgtaagtttgtttgagttctttgtagattctggatattagccctttgtcagatgagtagattgcaaaaattttctcccattctgtaggctgcctgttcactctgatggtagtttcttttgctgtgcagaagctctttagtttcattagatcccatttgtccgttttggcttttgttgccattgcttttggtgttttagacatgaagtccttgcccatgcctacgtcctgaatggtattgcctaggttttcttctagggtttttatggttttaggtctaacattaagtcttcaatccatcttgaattaatttttgtatatggtataaggaagggatccagtttcagctctctacatatggctagccagttttcccagcaccatttattaaatagggaatcctttccccatttcttgtttttgtcaggtttgtcaaagatcagatggttgtagatgtgtggtattatttctgagagctctgttctgttccattggtgtatatctctgttttggtaccagtaccatgctgttttggttaccgtagccttgtagtatagtttgaagtcaggtagcgtgatgcctccagctttgttcttttggctcaggattgtcttggcaatgtgggctcttttttggttccatatgaactttaaagtagttttttccaattctgtgaagaaagtcattggtagcttgatggggatggcattgaatctataaatttccttgggcagtatggccattttcacgatattgattcttcctatccatgagcatggaatgttcttccatttgtttgtgtcctcttttatttccttgagcagtggtttgtagttctccttgaagaggtccttcacatcccttgtaagttgtatttgtaggtattttattctctttgaagcaattgtgaatgagagttcactcatgatttggctctctgtttgtctgttattggtgtataagaatgcttgtgatttttgcacattgattttatatcctgagactttgctgaagttgcttatcagcttaaggagattttgggctgagacgatggggttttctaaatatacaatcatgtcgtctgcaaacagggacaatttgacttcctcttttcctaattgaataccctttatttctttttcctgcctgatcgccctggccagaacttccaacactatgttgaataggagtggtgagagagggcatccctgtcttgtgccagttttcaaagggaatgcttccagttttgcccattcagtatgatattggctgtgggtttgtcataaatagctcttactattttgagatacgtcccatcaatacctaatttatcgagagtttttagcatgaagggctgttgaatttggtcaagggccttttctgcatctattgagataaccatgtggtttttgtcgttggttctgtttatatgctggattacatttattgatttgcgtatgttgaaccagccttgcatcccagggatgaagcccacttgatcatggtggataagctttttgatgtgctgctggattcggtttgccagtattttattgaggatttttgcatcgatgttcatcagggatatttgtctaaaattctctttttttgttgtgtctctgccaggctttggtatcaggatgatgctggcctcataaaatgagttagggaggattccctctttttctattgattggaatagttttagaaggaatgataccagttcctctttgcacctctggtagaattcggctgtgaatccgtctggtcctggactttttttggtttgtaggctattaattattgcctcaatttcagagcctgttattggtctattcagggattcaacttcttcctggtttagtcttgggaaggtgtatgtgtgcaggaatttatccatttcttctagattttctagtttatttgcgtagaggtgtttatagtattctctgatggtagtttgtatttctgtggtgtcggtggtgatatcccctttatcattttttattgcatctatttgattcttctctcttttcttctttattagtcttactagcggtctatcaattctgttgatcttttcaaaaaactggctcctggattcattgatttttttgaagggttttttgtgtctggatcttgtaggtatgcttcattgtttcttattatttttttcttttgtcttctctggctgtgtattttcaaataggctgtctgcctacaagatccagaaaatagcctcaaaagggtcaatctaagagttattggccttaaacaggaggtagagaaagagatagggatagaaagttgatacaaagggacaatatcagagaacttcagaaacagagaaagataccaacattcaagtacgacaaagttatagaacaccaagcagaattatctcagagactacctcaaggcatgcaataatcaaactcccacaggtcaaggataaagaaagaatcctaaaagcagcaagagaaaggaaacaaataacatgcagtggagcttcaatacatctggcagcagatttttcggtggaaatcttaggccccgggcatatccagagatgctgtctgagggccagtcattggagtcaaaaaccttagcagtttacctcatgttctattctattgtggctaagctagcactcacaccacaatataaagtgctccctgctcttccttgcccttttaaaaggcagaggatcctctccctgtggccctcaccaccatgagggttctgcttggcctccactggtgttcacttaaagcccaagggctcttccatcagcttgtggtgaatgctgagagaactgggacccatattttagggccttgggctcccctctggcccaaggcaggaccaaaaatgctgtccaagaacctaggccaggactcagaaatcccagaagcctgcctgcttctctgcctttctgtggctgagctggtacctaaggggcaagacaaagtcccctttacttttctgtctacttttctcaaacagaaggggtctttcaccataaccaccacagctgggaatttgctgggtgacctatgaagccagcacatctcagaggccaagtcccacagtgtactccctgggtattgcaactggttattcaacgttcaaggcctctttagttagtagctgatgaatcctgataggactgagtccttccctttaaggtagcagattcccttttggcccagggtgtgtctagaaatgctatccaggaactagggcctggaatgggggcctcatgactctgcccatgccccatcctactgtggctgagctggtatccaagatgcaagacaaagtcttctttacttttcgctctcttctccttaacgagaagtaaggagtcacttctgttgctgcaagcttcactgctgggagtaggggaggtatggtgcaaccactcccttagccatgccagctggtgtctccctaggtcatgtgggagaccctaatccactggcttcaatatatagagggacgtttctaaattatttatctgtaatttgattaagaagatagacacaggcaataggatatgccaacagattctctctaacctatagttattttaagaaagttagggaaagagaggtcattgattagttttggcttactgaattatttgaccctcccatatcttttaatttatggattttatataaggcacagatattctactagtaaacatgacattaaagatgttttatacaaatgaatgtggttgatacaaaggcattaaataagaaacaaaggaaattcagaggacatttgttcgcctggaatagagatcattagcataagcataagaggaaaataaggaaggaaatgggaaagtcttgagtccattttcaaattatgaaaacttgaaatgcaacaaacaaatagtggttacttaagaagaaagactgaagatgctgggcaaaggttaactttagaaatggcatttttatatcattataaagagaaagtggggataatggaaataatctacatgtacaactcatttgacagacatttattgaaggtattccaaatgccaaacactagtttgtgcactaaggatgtttttaatttttactttttactttatttttattttctagcttcttccgctttgccagagaaggatttttttaaatggataaaatactaacttaggctagcttctttcagaaacagacctttaaacaatgattaatggtgaaagtggtttggttgtaatgtgatcccaggaagtaccagtaggagagtgggacaatgagataataaatgaaagaagccaataattaagccagttatggaactagttattgctttgggccactggggtttgatcctgatgaaggagctctgggagatagtaaacaaacaaacaaacaaaaaacatgcctcaaagttgtcaaccacaagggggtaaaggcaaggaaccagggctaactattccaactcttatccatcattggctaaatgcttcctggtacataaactttccagcacttctggccagcgcacctagcaagctgaggaaaatctctcaggtttgcagtagggcaaatgcttgtactaggacactgctggcatatacttgaaggatgagtgccaacggcagatagatgggccctgacagcatcttctacagattctgtccttgcctttgaggcaaggacactgtctagagtcagagacagaaatgtaaaatgtaaaaatgtaaatcatagtagcacacagtacaagttttaaaatcttaacaaagtgttatgggagaaccacggtgagagaaaatgactgcacatatgagagcaggggaagtctttatatgtgatgatgacatttgagtgggtgttccgttatcaaagatctacttaaaagggaaaaagagtagaattattttaaaccatggatgtaaccaggcgtggccaccctatatgtgaatgtcctgggataattttgtccccagatgtctctctttttgagtgtcattttcatttatgtattcataatataaagaaattgaatagaaagaggtaaacattggtggcaaaaatcccttcctacccataaggctcacagaataatgttgtctaaatgccataacatttttggtaagttttggttctatgggctttggaaattttttatgtaggaactcctccaaggtgatataagcattcagtgtatttatctagataccctagttaaagctactttaagcaggatcaaagtcctcttttaaacttttgtatttgaaagctattcccatgtacaattcccatgattcttgtacaattcctaggagacctttgtttacatcaaaagagtttgtctctctctataagttagaacttgtacattgtagtaatggaaaatccatttcaaagtagcttagacttactcagacaaaatgtattgatcagtgtcattaaacagttgaaagatagacgaggcttgattcaggaattaaatagcatgaccagattctagttttccttctccattgcatggctctgctccccagtatttgttccgtttaattcctcttaattgttctaagatggatatcaggatactgcagaactacgtgctttctcatccatcttaaacaagaagcaatgggttttctcttttagaatcacgaacaacaacaacaacaacaaaaatcctagagttgtttcattggttctgattgaccttacttggaaccataagtccatctttgaattaaccactaaagccagggagatgagttaaaactaagtacacaccatccacagagcaaagagaggtctattgtgggaaaactgcacaaatggaaaaataacaggggaaacacaggagaaggaggtagttagttaatgttcaatacacgcaccttctcagggacttttcttccatctggcatcatctttgtcttttgaccattttccccaatcaatacctatattcatactcaagttttccatatttgggaaaaaacttctcttgacaccaaactcccctctgacttccttcttataatgatctatggttggatagtctacaatttactgtccttactttttcataggtattttttaatctcctacagtaagatttctaccactgcactgaaatcattttgtgtatggtcttcagggaattccatgtggccaaagccaatggatacttttggcatgggctttggaggtctaacttcttgaatccaagtgtcggctctaacaatcactatctatgtgaccttagaccagttatttaacgctgtctttatttcctcatttgttaaatgaggataattgcagcaatagaaaaagaacgtaaacaattatacttataggattgtatgatgattaagtgattaatgcaaggaaagaacaacacagagcttcagacagtgtagatattcaaataaatgttagttatgatttttattatgtcttgtgacatctatgagatttgaaagtgttaatcactcttgtgtttttgaaaatctttcttttccatgttctataaaagtacactttcttgatattcctcctccttctctagtctttcattcatcttatttgctctttgtgttttatttattctttttacgttgtattttccaggagtccattcccagcccggtgttgggctcagtctatgtgccatataaatgagaatgcacttgcatttgaggctttgctttttatttctctgtagtgacggccaatcccagatttctgtctctcccaaaatacacagctatgctatagatccttcagtcctcctgactaaaatgttagttttatgtgtgtgttcctcacaacctcccagtgaataggtccaaaactgaactcattatcttctccatgctcactctgcattctttggataggcagtgaatagcaccactatctaacaggcacctaaaccagaagccaggtaatctgtcttaaacccttttgttttccaagttcttatcataatggctggtgtctaacagatggtaaataaaatagagactagctggctacatggatggatgtgtggggatgcacagagggatagatggattattgagtgagtctctagcctataaatatttttaattaactaataaattatgataatgtacagttgaaggtcaagggtgaaaaagcataccctcagtgggatgcacaccccaaggagccattttaacttgctacataacacacatatgaccacttttttgctgaaagccttctattattgagcaagcattcaaatcccatgtttgcctgaaataatggttcaggttataaaagtttccttctttttccaggattaaaattatcttcctacataataggaagaactgctttatcttttcctaatatctagagatggccttttaaaaatatagactgttttccctattgaaatgaactgtaggatgtacaaaatatttactggcatgaatcaaaagagcttgctatgtttatgtgaaaaccactaggcattctaaaaaatattgctagcatagtaaaatgttagtaattaagactaacgaaagcgaaggcaaattggaatcagagactatttttaaggaatgtcaactgtattattttcaaatacacatggtacataacagtaggatatgagaaaaagtcccaagtatgtgtactaaagtagcctgctatgataagttgaaaaagggtttgtaattggaatatccacagaatatttcagaacacttaaagacattttcatttacactttatacagctttcttataagagcatttacaccatttattttataaaccaaagattaattagaagactaaacaattacaaggcctcaactacgaaagctgttccactacctagtggaacaacaacaatgagacacacaaaacaatggcgttcaaagattagagagagacttacggttaaacagaggttgacatgttaactgaagttgcaatataatatgtcgactagttttgcaatacatagcaaacacccaaacagaaataaacctgataaaaaaacagtagtctataatgtgtgccacttactgagttttaattattctggggactatatttttgatttcatgttacaatcactagttttgtggggtctttctagtcctgatgcttatttacaaaatatctgaagtatttctttctatgtatttatttttgagatggagttttgctctgtcacccaggctggagtgcagcggcatgatctcggctcactgcaacctctgcctcccgggttcaagtgattctcctgcctcagcctcctgagtagctgggattacaggcgtgtgctaatttttgtatttttagtagagactgggtttcagcatgtcggtcaggctggtctcgaactcctgacctcatgatccacccgctttggcctcccagagacctgggattacaggcgtgagccaccgcacctggccatctcaagtatttctttaacttataacttcacataactttgtggaggcaacagggttaattaaaaaggactttacttacataacaaaataagaagcatagttttatattcctgtgccatatacattttgtttgtccatctgtagccattctttgaccttctctcccttgctctttattctgggaggctgacctctgtcatcattgggctcccatgccctttggcttccagttggtttaggcacccaagagccctagaaggaaattgaagacaggaggtaaagtgaggtcaagatatttattctcctaattccctccctttgaggttgccacaggctgactatgtcctttgacaaaaggttattgctcttctcagggtggtttctcattccaattctctgcttttggccacttttccctcccctcatcccttgggcctagatgtagtaacagctctactgttgcaaggttcttgtattatctgtgatggtttcttataccctgcttatcttgtgatttgttgctttgtagataaacctctcagattatctaggcaagatcatagaagaacacgtatgtccagctaagatattccagaagacagtagggaaacattgaagggttttataagagggagtgcagtgatcagatttatgttagttttaatctttaattggggtagaatttacattctaaaacagagatttgggtctgggaggatgatatagagcctcttatggatgtgagggcaaaaaatgatagaggtttgcagtgccaatagaaagaggaaagaagttatatatgagagaaatttgtaactaattatatgaggtgttgggtgacgcttaggaaagaatctagaatgtctatcaggtttcatgcttaagggataaagtagatggcagttttattacttgttttctgtattatttttatttcataaaaccagcttagagaagttgcatagaaaaaataatgtagtcctgtttattttaatatttgaaaagaacatatttcagagtagaatctatatagtacctccctcttggacttccaatgataccagtgatagcctcaatataagccagtcttacaaaatgcacccagcgtgaattcttaggtattgttaaaagaagttggccaggcgcggtggctcacgcctgtaatcccagcactttgggaggccgaggcaggtggatcacctgaggtcaggagtttgagaccagcccggccaacatggtgaaaccctgtctctattaaaaatacaaaaaaaaaaaattagctgggcatgatggcacgtgcctgtagttcctgctactcgggaggctgagacaggaggatagcttgaacccgggaggcggaggttgcagtgagcggagattgcaccattgcactccagcctgggttacaagagcaaaactccatcaaaaaaaaaaaagaaagaaaaagaagaagtttctaatacacttatcttcccttgggttcactcagaagacccttggaaaaggttttaagagcaagtgatttatttggggggtaaattaatcagtagaagagtggaaaaatgagacaggtgaggcaaggcagccagtaaagagtggtgcattatcaagccagctgctgttgtgggtcactggagctttatcccttgggaaactctggaacccttgtaaaatacatgcctcagagttatttcccctagcatcaagggagctagtgtaacaatatcccaattcctacaattagtcattatatacaggctgcctctgggagctggaggggaggcatcagttgcctggtatgtctagcctgtcacatggatggcaaagcaaactcctgtggcaacagaaagccttcaggcaatgaaatgctggcactgggaaatcaggctgatgggtgctgaagtggcaaggatgaggggatatggatattctgctgtagtgcttttctaacagatgattcatatttggttctagggatcaagaattgagttaaaattttatatatatgttgatgttctatgtcaccttcaggaaaataatttaacagaaactaatatttgccatcaaaaaagcaaagaatcctgttgttcatcatcctagccataacacaatgaataattttttaaataagcaacataaatgtgagataacgtttggaagttacatttaaaatgtctcctccagactagcatttactactatatatttatttttccttttattctagttgaaagaattcagaatcagtgggatgaagtacaagaacaccttcagaaccggaggcaacagttgaatgaaatgttaaaggattcaacacaatggctggaagctaaggaagaagctgagcaggtcttaggacaggccagagccaagcttgagtcatggaaggagggtccctatacagtagatgcaatccaaaagaaaatcacagaaaccaaggttagtatcaaagatacctttttaaaataaaatactggttacatttgataaaattataccatagattgtaatttaatgatgtttaatgtaaagttattaacagaaaatcacgttaaagctgaaatgaacagtagactttgtatatttattttcttagagacagagtctcactgtcacccaggctaaagtgcagtggcacaatcatagctcactgagccttgaactctggggctcaagcagtcctcctgcctcagcctccctagtagctgggactactagccaggcgtgtaccaccacgcctggctaattttttaaaaatttttgttttctgtagagatgggttcttgaactcttggcctcaagcaattctccttccttggcctcccaaagcactaggattacaggcatgagttagcatgcctagccagtagacttttgagtcaaggtagagaatagaggaaaattgacagctaatgtcaatgttaaagttaattttgtttagtaatctggatatagttggctggttttctgttgcaccatctttaagatcacttcaaaattggtatacgtatttatgtagttgcatgaagtcaaccattcgggcttaattccttcctagaaaaagtaacaggtctactctttcatatcttatttggaggccctggatcaagaaatgggggtgagtgggtatcaggattggggaggaataaggagtactctcactttctccccccattctcttacctccagcccagctcattcttctcttctttctctttcctctgaaatttcctcaaatatctgtctgcttagtagtctataattcctcaggataaaagaaaaaggaaaaggaagaaaattgcttaataactatgttttatcaagcagcatgcatagtgctttgcatgcgtttaatcccttcaaacttagtatttactagtcagtttgaaaagcccttaaatgttaaacaatggttaagctttagggtattttgagcagggaagtaacatggtaggaggttgatcagattgggcacttgatcaaaaccctctatagatattttatctgacagaaaaggccttttgctaaaccagtatctgattctcaaattggttatgtcatctaagaaggaaaccgtatcattttcttggatgaaatggcttccatttccaaattagtcaggttaggctatgctaagctatagtaagaaatgaactctgaaatctcaatagcttaacacaataaagactgctttcttggttatatcatagtccagtagaggttgacaagccattcttaggagctgtcccccaacatggtcacttggaaacccagacttttccaattttgtgacacttgtcattttcaacacactgccaaaagccactgcagaaaaggaagacagaatgtggtcagtcaatccatggtgttttatggccaggcctggaaattatgtatatcacttccaccacatcccatcacacagaacttgttctcgattgaatttcaggaagagttaatggaattagtgagcttttagccaatctctgtcatagccattttatcgaagggacctgagctgctatgaggacaaggttttagtttatatgatgaggatgttagaaagccacatagaattttacagtcttatcattagctctgttggagtcaaaatctaggtgaataaaaattctttcaagagacacatgttaccactaatggttttttcaatggatgagcatagatgaattaggaatctccaatggtcattttcctaattcctggtctgactatgtaatatatagaatcatgtggttattcttgaaagctctagtcatattcgtgaggtagtcagcatgttatgctacttctttttcttctctataagtttcggatactatgaatctattggatcacaaaccaaagtagttaactggtaagaaggtataagcagaaaatacgaagtttggactggatccttgagttagatgagaagaaggagagatgagaggcatacagtgatagatttgactagggcaagaggactctggtagttagcaaatgagaaataaatttaacctaagaaaatcctaaagtgatggtaagaatggttagggtttaattgctcttagaagagcaagtagctttaaataagagacaaaaatatctgcagaaggaaatatgaaagtagaaaacaaaacaattgcattgtcaaaacatgtaagatgttttaatcacctaaaataaaaccagaattgtattataattgctatcctttgtcaaacttttgaaattaaaaaaaaaaaacgctttggaatggtctaaaactacatcataaaaatggctcagccactatctatagagattgacattttttgtttgtgctctgtgtttaggaatttaatgatgtgtattgctgcagattcaatgtaagttcccgatacagataaagatggccaaagctgtaattttttcatccatttcttgaatgatgtatgctaaaattaaagtaatcctaatgttaataataacttttagtgaatgcttgctgtgtgtcaaaaagtatgctagtcactttatatatattggtttatttcatcctttcaaaaacactctttgaaaagtactcttattattcttagtttgcagagaagaaaactgaaggctagagaagttcagaatcttcttttgaaagtagtagagttgtgatgcgaatgcatagcaattactcttgtagatgacctcacaggcttcctcttccaattgtctacgtggctaaaacaaagcaagaaaaccccataagaatctgaaaaagactcatgtaattattaattgacaaataagattatattacattactgataaaccaacaggtagaaaatgaaagcaatgaaatagtatactgcgaaaaaaaatttcatattatattctttgatgaaaaaataaaacaataattgcaaactgcatttcatttttaatgaaacgacaatgtttaattcttctaaaaggtagggagcaaataaaatggttatctggtctttacatcgaatgtgtcatcactactaagtgatattagctggcttattacttaaaattttcttttaggaaaaaagtgtgaaaatagacaggaggagacattaaatggctaaagcaacacccccttgctccgtaagttctttctgagtctgtgtgcctaagattaacaagagagcctgtgagcctcacaaggcaatcacaaagctatgtctacagccttggagagctgtgattacagcagccagcctcctttgcagcacctcagtgatgactacactaactctcactactgagcaacaatgaaatgtttcaaacccaaccaccaacactgttataactcttaaaatttgagccagtcaccatacctgaacgtaaaaagaaaattaccaaaaatgcttgataccaaaaagcaattaatgattcataattgctaatctttattgacagtctcttctagttcttatctacatatattttaattgtctacataatgtaaattaaattttaaattctgatttgtaaacttaatattgcataaatatttatcaatgttgttaaacatcttttaataattattttaacttctttatattatttcattaatttccatctttatgtccttgctggtctgacatttagaaaaaactcctccttttatttagaaaaaaagaatggtgaggccgggcgcggtggctcatacctgtaatcccagcactttgggaggccgaggcaggcagatcacgagatcaggagtttgagaccggcctgaccaacatggtgaaaccctgtctctactaaaaatacaaaaactagcctggcgtggtgctgcatgcctgtagtcccagctacttgggaggctgaggcaggggaatcgcttgaacccgggaggcggaggttgcagtgagccaagatcacgccactgcactccagcctgggtgacagagcaagactctgtctcaaaaatacataaataaggagaataaatggggacaataacaacctattcacagaacagaaataaaaccggagatgtcatgtggaaaaagcttatcttgaaagcgtggtcagagtggaaagaaacagcaacaggagagtcttgatttggtgaaaaaacagaatgcagatggcatagagtatcaacaattaattagcaggccatcaagagacggccataacatattggtaattgttttctttcacccttaattttttctaaaacaaaaacatgaagttagaaagtagttaattttgttagccacatggcttcatggtttaattttatcttctctatgggcctggtacaacaataaagttcttttgagatagaaagacagatgttaggcaaaaacatacaagattttcattctaatcaaaatctttgccaataggctatgacagaatcctatgagagatgatgccatttagaactttcacaagaggcaaaaatagtatgccattggcacctaaaactgccaacagtgatcatcataggatttatttcatttggcggattcttggttgagttcataacctgttccctaggcttttaagattggtccaaacttggcaatggattctttggaaaaattatttcttgatcgttttaaactttcttttccagtgtcaagagagattttcccaggctccgagttttcatttattttttcccctgtcagtttttgaaagagaaatcccctttttgtcggctttgtgattgcttttgtgtcaaattcagcgtaaaagcttttcaaacgtgacagcattagctgttttgtgcttggctgagctaagagtacatgaattcaatagagaagtgaaatcttgtttgagcctggctgatttggctatataatattgaaaactatctgaagcaagaaattcaatacttttcaaattattgaataaacatttctaaggctgcaaaatctctgtgtttttgaaggcattctttaggaaacttgaaacacagacattctataatcacataattaattttaaaagttgaacttattgtatgtagtaactaaggcagctatttgagtgtctcaaattattttactaaaaagggagacatttttcaaatatggaagtagtgccttacatttttagttatctgtggaaggatcgatggcatcatatatctcatccaccataaaaatatgtacggtagtggaaactgaatttttcttttatatattttgtgtattttttggagttgtacaaaattaaatcagcaaattgacccacactagtagtttgaggtttgggtttctggtacaataatgaaaagcattattagaaatcttcttgccaggacctaccatttcttcatgtattttctttattcccttttgttctcccctaaagcttctatgtgattaaagagaaaagatcaataacccaatagtacttttccttctaaagtatgcatgaaactcttaaagttctcaaagcatacaaacagagtgctctctacattgctgatagaacacaggtagtaatgggctagtttccccaggtaactattatattatataaatatttaatgcagagtcaccaagccttgaataactttatgctttgattgtaccatattttctctagtttgcttttcacaatttaacttatcccgtgcttgaaaatataatgtggtaactgtgtaaatctgctcctcaaaaaattttcgaaatcatcttttcttttttcttttctttctttttttcctttttttgagatggagtctcactctgtcacccaggctggagtgcagtggcatgatcttggcttagtgcaacctccacctcctgtgatcaagtgagtctctcagcatcccaagtagatggaactacaggcacattccaccacgcccaactatttctcgtgtttttagtagagacagggtttcactatgttggccaggctggtctcaaactcctgacctcgagtgttccgcccacttcagcctcccaaagtgctgggatacaggcgtgagccaacatgcctggccccacatcgccttttctgaaccctgggaattaaccaaaggctggcaacaatttttgaaatgctgactctcaataaaaatggcaaagtttgaggttttttaagttggcctttcccgtcactttctcccagctccacagtagccttgaaaatcagtagccttgcaaccataatagctgtgaaaactagcagccttttagccaccagagagtgtagaccaggattggaattcttcaaaaaggccaattttattccaagaaccttgccactgtttgacctatcttgcagctccctggaataaacctatatacatggccttgcctttatttggcccgacttagagataactttctaggaaaagccctagctccagggtgttggtccaaaccaattagcagcaattctttaacataacaggttcctaaggctgtgatgctagttgagataaacataggtctggagaaaaacttccagtgaagctctggagaatgaggtgtccataggggattttggcaacctctgacatgttcttgcgggatctagaagcccatgtgcttgtcttaacaaatagagagtatcaataaagagatagaaattgtaaataagaactcagtggaatatctggagttggaaagcacaataactaaaattaaattttcacttgacgtcagattcaagctgcaaaagaaagaatcagcaaacttgaaaataggtaaatgggataatccaatccaaagaaaagaaagaaaaaatattaaggaaatacagaaagcaaaaactgactgaactgaaagaagaattaggtaattcaacaaaaatagttggagacttcaacatctcacttttaataacaggtaaaagaactaggcaaattaacaaggaaatagacacttgaaaaagactataaagactataaacttacaagacctaacagatatctatacagcgtttcatccaataatagcagaatactcattcttttcaactgtacacgaaatattctctagggtaggccatatgctaggtcataaaataagtctcactacattcaaagggattaaaatcatacaatgcagattttatgaccataatggagtacaattaaaaatcagtaacagatgtaaatttgggagttcataaatatgagaaaattatacaacacactcttaaatagccaatgggacaaagaagaaataagaaaatacaaaaatatcttgagataaatggaaataaaaatacaatataccaaaacttatgggaggaggctgaagcagtgcttagagtaaaatgtataactataaatacctatatttaaaaaggaaaaagatctgaaatcagtagcctaagcttctaccttaagaaactagaaaaagaagagaaaagtaaatctacagtaagcagcaggaagtaataacaattagtgtgaaaaaaatcagatagaggaagaaaatataatagaaaaaatcaacaaaaccaaaatctagaaatttagttatttgaaaaggtcaacaaaattgacaaagttttagctgattggttaggaaagaaatggtcaaattactaatattagagaaaaagagggtgcattactaccaacattacagaaataaaaagaagtaaaagaggatattatgaacaactaaacaaatagataacctggatagacctataacaagaaattgaattggtattaaaaacttctcccaatgaaaggctcaggcccagaagtcttcccccgatgaattctaccaaacatataaacaactcttccaaaaaatagaagagaaaggaacacttcctaaccagacaaagatatcacaagaaaacaagctacagagcaatatgccttatgaatatagacttgaaacgcctcaaaaaattatcaaacctaatacaacaacatattaacatgattgctaccataaccaggtaagatttatcacaggaatgtaaggttggtttaacatccaaaatttaatcaatgtattataccatatcaatagaataaaggacaaaaatcgtatggtcatcacaataaatatagaaaattcatgtgacaaagtacaaaaccctttcaagcttgaaaaataaagaacacttaacaaatgaagaatagaaggtattggccaggtgtggtggctcacgcctgtaatcccagcactttgggaggccgaggcagttggatcacgaggtcaggagattgagaccatcctggctaacacggtaaaaccccgtctctgctaaaaatacaaaaaattagctgggcacggtggcgggcgcctgtagtcccagctactcaggaggctgaggcaggagaatggcgcgaaccctggaggcagagtttgcagtgagccgagacagcagcactgcagtccggcctgggcgaaagagcgagactccgtctaaaaaaaaaaaaaaaaagaaggttttgtggattgaatagtgtcccccgctcccaaaagacatactaaaagcctgagcccaggtatctgcaaatgtgaccttatgtagaaatagagtctttgcagatgcagtcaagttaagatggtatttttataagaagaggaaaagaggcatacacagagagaagaatgccacataaaggcactgaccacgggaaaaacaccatgtgatgttacagttagagattaaagtgctacagttgcaagacaagtaaaactaatgattaacggccatcattagaagcaaggaagaggcaaggaaaaattctcccctacaggtttcagcaggagtatgggcctgctggaatcttgattttggatctagcctccagaagtctgagacaatgagttttgtctacccagctacgcaaattgtgacacttaattacagaagcccgaggaaacgaatacagaagaggatttcctcaacctgataaaaggcagctacaaaaattccacagctaatgttattgtgaaacactgaatgctttcccctaagatcaggaaatagtgaaggatgcctggtctcaccacttctattcagtattgtactggaagttcaggccagggaaattaggcaagaaaaataaataaaagacatccagattagaaaggaataagtaaaattatctctacttgcagacaacatgaccttgtaattagaaaattttgaagaatctatgaaaaaatattagaaataataaaataattcagcaaatttgtaggatacaagatcaatatacaaaatgaattattttatacattaaaaatgaataatctaaaagtgaaattaagaaaatatttacaatggcatcaaaaaatgttaaaaacttaggaataaaagagatgcaaggcttgtatactgaagaatacaaagcagtgttgaaagaaattaaagataaaaaaatagaaaaatatcacatgttctcagatcaaaagacttaatattattaagatatcaatatccccccaattgatctacagactctatggaatcattatcaaaatcacaactggcttttttttttttttcagaaattgacaagtggatcctaccatttctattgaaatgcaagggatgtagaatagtcaaaacaaccttgaaaaaagaacaacattggaggagttaactttccaatttcaaaaactactacaaagctacaattattaagtcaatgtggtactagaatgtgaatagacatatagatcaatgaaatagaattgaaagttcaaaagtaaacctttgcatttatggtcaactgatttttgacaagggtaccaagagaattcaatggaaaaagaatagtctttcacaacctggtgctagaataactggatatacacatgaaaaataatgaaatttggccccacctcacaccatacacaaaaattagcttaaatgtatcataaaagaaaacaaataatctgattaaaatgggcaaaacacttaaacatttctcaaaagaagatgtacaaatagctaacgggtttgtgaaaaatgctcaacatcactaatcattggggaaatgcatattacaatcgcagtgagatgtcaccttacacctgttagaatggctgttataaaaagagaagaatgataacaagtgttgatcaaggatatggaaaaaaggtaacacttgtatatcattggtgggaatgtatattagtacaaccattatggagaacagtatggtagctcctcaaaaaactgaaaacagaattaccataggatccagcaatcccacttccgggtatatatccaaaagaatttaaaccagtatgtcaaagagatatcttcactcctgtgtttattgcagcattagtcacaaaagccatgatatggaatcaacctaagtttccatcagtggatgaatggataaagaaaatgtggtacatatacacaatggagtattattcagccttaaataaagaatatccttttgtttatgacagcgtggatgaacctggaggacattatactaaatgaaataagccaggcacagaaagtcaaatactgcgtgatctcacttatgtgtggaatctaaaaaagtcaaactcattgaagtagagagtagaatggtggttaccagaggctgtggatttaggggtggaaaatggggagatgttgatcaaaaggggttaaaaactttagtcaggaggaataagtttttgagactttatgacacaacctggtgaccatagttaataatattatattgtatatttcaaaattgctaaaataacagattttaaatgttcttgctataaaatatgataaatatatgcagtgatagatacgttaaattgctcgatataatcattccacagtgtatacatatatcagaacatacatgtaccccataaatgtatataattatttgtcaaagcaaaataaaattaaaaataaaatgttttaaaacttttgtaaaataaactttataataataatatatttttaatgaatcatagagctaaatatattaataagaactaaaactttaaaactcttctaagaaaatgtaggaatacaatggattatgcagtgttttcttagatatgacaccaaaagcaaaagtaaccgaaaaatacacaatttggactttaacaaaattaaaacttttgtactgcaagcaatattgtaaagaaagggaaaagacaatcctcagaatgggtaaaaatatttgtaaatcatatatttgataagatacttgtatcaagaatatataaaaactcataattcaacaacaaaaaggataaatgacttaattacaagtgaagaaacagtttgaataggcatttctccaaagtagatgtatagatctccataagcacatgaaaagatggttaacatcattgattgtttaaaaaatgcaaatgaaaaccacaaggagatagtactttttacccactaggatggctaatacaaaaaatacagacaataacaagtgttgagaagatgaagaatgcttggaattttcacattactggtggaaatgtaaaatggtgaaacaactttgaaaacagtttggaagttcctggaaatatttttttaatttttaatttttgtgggtacacagtaggtatatatatttatgggatacaggaaatattttgatataggcatacaatgtgtaacagtcacattggggtacctggcctatccctcacctcaagcaattatcttttctgttacaaacgacaatctaataataatcagttatttttaaattcacaataaattttttgactgtagtcatcctcttgtgctatcaaatactagatcttattcattctatcaaactatatttttgtattataaatttcactacccattagccatccccccctttccccctaccactacccttcccagtctcctggaaatattaaacatgaagctaccatatgacaaaaccattctactcccaggtgtatgctgaacagaaataaaaatacatatgtacacagaaaacctttatacagatgttcatagcagcattatttataatagccaaaaagtagaaccaacccaaatgtccatcagctaatgaataaattttaaaatgtcctctacatccaaaaatggaatattatttagcaataaaaagaaatgaaatactgatatgcactgtaacatgagtgaacctcaaaaatatgctaagtgatggaatccagtcacaaaagaccccaaattgtatcaatacattcatataaaacatccagtaaagactgaaggaggaggagaatagacaatagaaagggactgttaattggtatgggtttcattgggggcaaataaaatgttctcaaattagatcataataatggttgcacaaccctgaatacattaagaaccagaaaattatgcactttaagtgggagaattttatggtatgttaaaaagtatatctgcatgtcattgactacagatcttttcttattttttcaagttttatgaacacagttttagaaacatagtctccatttttctctttcatgaagctgcttgccagctatagaaatgaaaaaatagccatgtctgtggaacataactgctacctagatgggagcctccatcacacaatggatagggagctattttcttttatggtcaagataggcaggttctgtcctatagaatatattctgagatgttacctgtagttcagaaaaacagggatattgttgttctaaacatttcctcaacatttatgtggcttcctatttattaataagagaacctgttctttatgtgtcattatactagtttattctagccctggtcctggtccaggactgtctggaggtattagaattgccctactctatgtgaaataaggtcatatctgaataggtatgtcagtcagcataggctaagctacagtaataagcaacctcaaatctagaggcttaatagtctatattttactcatgttacatgttcgttgtagactgatgagagcattctacttagcttagtcactcggggaccatggctgatggtatctccatcttggtacattctttcatgatcatagaggcaaggaacatggttcttgagccttctgcctggaagtgaccagtagacaaaaccagtcacatggccattcctgagttcaatgggaatgccgatgtataatcttctggcgtgaaaaggcactggatatttgagaacaataatgcagtctaccacaatatgctcatggggtctgaaaaggagctgaaaaaacgccattttctggggttctgtcctctggcattgtttctggaatcgtttccacccatccatttctacaccctctcaactgacttttctcagatgcctggggtagctgggtgatttgttaattacagtattgcttaagccttttaataaagtcagcaaattaaagagagagcccagataaagagaatgctttcaaaaatgtcataatgaaattaaggtaacgaagcacttggagacctctcctcccttctttttgtatgaaacttattccaaagcagctggaagagaaatggggcctgaaagtaaagaggggaaaaatatattgtatgccattagtttaattataaaaattcattacatgaagccatgtaagacagaaaataatggaactctaatgggttggccgataacacatttactagtctgctctcagcttgtagtcattgttgaaaggacagaaaagtaacgacgttggtatgtagtcttcaaagctattgtaaagattaatcattttcagtaagccggaaaatgagggccattttcttaaatagtatgccctgtatagagtgttaccttctgaaacagagttgtttggtaatgtcagaggtttaatagatgagtcttgaagttaatggtgagaggctttacttttgaaatggctttcttacagctattttaacatttctattataaatccataaagaggttttataggtcgttttaattcacacaaggagggaagaaattgtgcttctcttttcccaataaggatttatagaacattaattcattcttgggaccaaattgtttagtgattttcaaaaataaactatgtatttttctgctgtctttttttcagaaatgccttactttattatacataataattttccagtcatgctataatcatcaagattgttttatattcttcaaagctcagttaaaataaacccagtccttttccttaaatttctttatatggatgcataacttctttaactgaattgaaatgaaacctgaattgagagtccagaaacctgcatttttatgatgactctttcactgactagctatgtcaccttgaacaagtcacttaacctttcagagcatttatattctcatgtggacaattatggaattgctcaaaaaggaagaagatatcaaaagatgaaagtgaatatgtaggtaggggtcatatattcgagggccttgtaatccaaagagagaggttaggactttgtcttgcaggtaatagcaaaccattgaaaggttttacacagaggagaaatgaggttctatttgcattacaaaaagatcatttacgcagttgtatgtaggtggaagggtggtttgagagtggagggagggagccaataaaaaagattattttagtacctgagcaagagatgatagggacgtaaattaaggtagtgtcaatggaagtagaagatttggataaaagttaaaaaaaaaaaaaaaaaaacttatgatacaactacccagggagtatgttccctgcctcctgctccagttgaggaccaacatatcagattgatccagagacagaattttggagaacattaatatttaaaggacaggcaaaaaaaaaaaaaaaaaagcttgaacactcagagaatacagaggcgaccaaaagagtggaagccaagaaagcagagaacttcgagaagagaatagtcagcagcaccagttgctgcaaataaatcaagtaaataagaacttaaatctttccataggcattggcttttggtaactgaatcagttaactattttcacaaatgtgagtggcatatagcaataagcccatattgcctttcatgaattttcagcttgggtggggtggcacttcttcatgttgcaggttgattggggtcgctctgctccatatgtcactcattctcctcctgagatgagtaggctagtccagagcatgtttgtcttaaggtaatggtgaagtgcaaaagggatagccacactgcataaatacatttcaagcctctgcttgtgttacttctagtaatatcccactgggattaggcaaagcaaggcgcatgaccaagctcaatgtcaagggcatgctgtctttcgtaggaagaatttcagagttacttagcaaagggcatggatacagggagaggtaaagaattggggccagtaattcaatttgccatagtgacttctgtcagaatagttttagtggaacgatgatggcagaagcctgattttcatgaattggagagtggcacgaatgtagtcaagttgagataatgagtgaatatctgccttctaaagagtgtgactgtgaaaggaaagaaaatgatagagtgcagattattgttgttgttgttgtttaaagatgagagagacactcatgtttgaagtctctagagaaggtccccgcagagaggcaagaagttggaacacacaaagagagagggagtatgtggaggaggatcccagaatagatgggtgcccagatggtgaaatcaacttccaatagcagaaaagtcgcctcttcctctgagactagagagaaggatgcaagatgtaaagtctgatatttcatgaaatgtatgtttgatatattaaatttccccctgtggaattgtaggtaggatcatttactgtgagatttctttcagttcgtgttgtcaggaattagtctgtaaaccacattcgatatttcaaacagaggaaattcaatacagaggactggctcctccataggaatgaaggagctgacaaacccaacagaggacagtgaggcaacccagagtttagcaacttcaggaaactattaccacctcaagggctggggaaccgacaagttttaccaaagcccagaaaccagaaccatcgggtgctaattcacccaatgtaaggtctgcacagcaggtaatggaattacagagggagcagccgtccagtgggaaacggagacaaaggagatactgccaagacagagagagaagggggataattatcttgtttcaccctttctcatgctcttctgtctcccactagtgtgtctcatgacttaacctagttagaagccagctagcaagaaatcccaggaaattctgacctcctatgggagttagtacatctcaatactgagtggagtaggaaatgggtagagaatggatctaagagcaaacgacctcttggtggttagctaacagagttaaatttttccatgaatcccttggttcatgaatgtaaatacaggatccaaggaaaaataacaaatccaacatgtagaactttttgttcataagcatattaggatcctgttttacaattttccgagcaattgcttgattttgacacttcaggacaagccggaggcatggtcagagcaagtaaccccatcctagtttacagatgacaaaactgggacttacaaggttaatgacttccttaagatcaaactgcagaacaatggacaagcaaaacttcctgggaagatgtcctttcgttactctgcactgcctttcttgaagttcctttgagacacagtcattaaaaatttaagtaatagttcacccggaacaaacatttattttacttgtaggtgaatatcacaaaacacattttaaaaggaaatttaaccaatattcaaccttaaaattttaatgatagagctatgcacttgcttttatcttccaagttaaagggagaattttagagttgcagcatttctagacaatgtccataaaacagcgagctacttgctttgcattcagaaggggctcacactgtggggaatatagtttgactcattaaaattagtagtagatgtgctagcagtagtaatgatgatgatgatgctgatgctgatgatgattaatatttatttaatccttcgggcacgccaggcacctttgtaaatgttctccctgaattctctaagttaacccacctaatcatatttccacataaatactgttaatattcccatttagcaaaggaggaaactgaggcacagaaaagataattaactctcccatttgccactaagcgatcacgccaggattcaaacccagcaggctcattgtattgctcaggcttttagctactctttctcttcctcctctcttttctaccatgtagggtcaatatcactaaaataagttcttacacataaaagaaatgagagaagacaaacaattaaagtagaaaaaaatactcaaaattcttgaaattaattcaggttgtctcatagtccacaatcactttttctacctaagatactgtgaatatatatcaagcacatagtgcagtagcagcataatgggtttgaatgtgaaacatttctttcctggttggggaaacaatcttttggggatttagcattttatattcttcatagaaaacacacacacatacacacacacacacatacacacacacacatatacaaaggcaatctttttttataagctagtgctcacagtattttaaatttcttcacacaccatgatcaccacacaagcaattccctgtggtgtacaccattgtcaatggaattcagaaagagaaaagggtgtgtgtgaagtctgttgtatttttgaatttacactccttctgaggtctggagttatcccagtagtaaatttcacagcagtaggcaaagctggtcaaggtcatggttcctagtgtgaatgacacttgggtaaaacccaaggtgggcgggcagaatattaccgtaggagaaagggaaaacattctgtgtggggaatgtctttaagaagggagaaaaaaaaaaaaggctacctttgagaacctttgtgtttatataagggcctgagccccctcaatgtcagtcaaggtcagtgggagttttactttttaatcctacatcctcacaaaacctgggcagtattcagtgagggttagcactcagtcaagatttccttaggtataacagtcctaactttcgctgtgaatacaattttgcagaaaaatatatggcacgcgtatttctacctttcaagcattaaagtacatcaaaaagttctggtttgacgtcaagcctcactctttactaccttgtttagtaggaaatctgtcatttaactctagcttactatttctttcagagattttggaaaattctaggatatgttataatttataattttaggcatttttatgatctattgattatgtttttagattcattggcaccttctgcattttatgttttttaattttaacagctttattgaagtgtaattgatatacaaaaactgcataaaattatatgggctagaacatgtgcatatacccatgaaaccatccaaatggtataacctcttatatctagacttttcaaacaggaacctatgagtgatgggtggcttccaaggttatttaacttgcttgagtaaaataaatgattttaattatatatttactaaaaattttgtttttattttgtattcctgagcttttacatatatgctctgatactggtccatcataagtattttattaacaattcagtgttttataaaaggaattcatttgaaaaaaaggtaaccaagttattggtctcagttttgtggatgttcatgctattaattagcaatttaatagatgagagataataagctcttcttttaaaatgcaaatagcaccctctggatactaagggccaattacatgttctttcgtatcttggaatacatttcttttatcactttaggtttggcttaagtgaggaggagaaagaaagaagtggtaattttgtaccctaggatatttctagaaaaggcaagcctttggcagaagttccctcagaagggctttcaaatagtgcgaggatctgaaaagtggagaatagaaactgtaatgcttgataaaaggagtatggaagaaaaggcaggcattccacgcggataaatgttaattgttttgtaatagcagcaactatgctctgtgcctttagacactgtcctctgctttcatagcaaaagtcagtgatattggcattagcttcttgataatagtttggtaatctgggtctatttgctatatgcagtaaatactattacttggtttgattctaggatgttttagttaactgagaaattacattatatatagattgtatatgttcaataggagttcaccaaacacgctgaaattatgctaagaacactgtttgatttttattctgtaaatatcatactaacgcaaaagaacaaatattaaaacaaaaatgatttttctcctcagaagcattattttcaatttcttccatttcgtgttcagctcatgattatgtattcttagagataaacacagtgtagttaaaaattgtgttctgttttttacacaagaaaattgtgctctttttacagtgattactgtgcacatttgctacatattggaccattggaatgatgtattatgttcttttaatgtccctgcattaaacatcgacattgtttctctttttttttttttttttttttttttttttccgagatggagtctcactctgtcgcccaggctggagtgcagtggcgtgatcttggctcactgcaacttccatctcctgggttcaagcaattctctgcctcagcctcccgagtagctgggattacaggagcctaccagcacacccggctaatttttatatttttagtagagacggtgtttcaccatcttggccagactggtcttgaactcctgacctcgtgatccacccgccttggcctccctaagtgctgggattacaggcatgagccaccgcacccggcctgtttctcatttttttactgctttggttaatgaagattttaagtcatatagtatattgatcttcttttgaagattttatcaggataaagtaccaaaagtgagattattgagtcaatgggaataagcatttgtatgtcacttggtatctattgccaaattgtcctaatagataacggtccccagcagtaatacgtgaatgtgctagttttactggtcttttcagctttggattttattttttgttaatttaattggtgtccaattgtaccttttcaatttaatactctattttttattacttgaaagttaacttttttctttttaaataaaatcatcccactctttctcttgtttgaactacctgttcctattcctgtgtccatttatcaatgacttaacccatcctattgaatttgatataactatcttaacaattagtattatcttaatgcttagaagcctcctctctgcacttgcagaaatgtttaatagaaatttcaggttgatatgcttcgagataaaacctaccattaattgacttctttctttgaaatatgtttcaagtgatgagatagcaagtttgaaaacactgaattgccaaagacaaacaacgaagaaaatgtaggtgatttggtttagtaagattcttatattttgactttttttctaattttaaagtaaggtattctaaaagtattttgatccttcaaaaaattcgtgactagaataacagtactattcttttgttgttcaatattttctgtatgcaggtttagttgaacgccagtagatggcactaattacataaacaattcaacaagttaatgaagagggaaagaaatgtatgaggtttttttcgttcaaatgttgttatatgtcacatattcaacaattatatatgagcttatttttgtagtttttttctcttgtgataaaaacaattaagcccactttattgccaattaattgctactaagttgaaatacttgatactggttattgctcaagatgctgcatttgaaaagtttgtcctgaaaggtgggttaccttatactgtcatgattgactaaatcatatggtaggttaaaagcaatctaatatatgtattctgacctgaggattcagaagctgtttacgaagtattttaagacactccaactagagatttcataaaaaaaactgacattcattctctttctcataaaaatctatagcagttggccaaagacctccgccagtggcagacaaatgtagatgtggcaaatgacttggccctgaaacttctccgggattattctgcagatgataccagaaaagtccacatgataacagagaatatcaatgcctcttggagaagcattcataaaaggtatgaattacattatttctaaaactactgttggctgtaataatggggtggtgaaactggatggaccatgaggatttgtttttccaatccagctaaactggagcttgggagggttcaagacgataaataccaactaaactcacggacttggctcagacttctattttaaaaacgaggaacataagatctcatttgcccgctgtcacaaaagtagtgacataaccaagagattaaacaaaaagcaaaatactgatttatagctagaagagccatttatcagtctactttgataactctatccaaaggaatatctttctatctcatcatggcgcacactgccttacctgttatctgataaataagtcactttgggattcatgatagagttatagctgtacatggtctcatcctagtatctcactccacacacccaatgggaaaatttgtggagggcaatatgactcgtcacttcatttcccattatatatgaatggaaattaacagcgcttatagacagtatctcctcaaactaagccttgtatccttattatacctctcttgatctctagtgcttttttcactagcatttattccaatcataaataaaaatataaattatgtaactaattgttaaatatttgtcctttaaattaatctaaatgccatgagggcagagattttgtctttctcatttgatacatccccaggtcctgaaccacgtgatataatagggagctagtaaatgttttttgaatgatgactccctttgcagaatgtacaattaccttgtgcaagctgaaaaaatagcacctgtacaatatgaggaagaccacggtgaaaaataattgagttccaaaatatgacatcaattactgaaaaaataagctcggtgatttttaacaagaagtaaaagtcaccactggggccaaaacagattttgaactaagagtaggaagtcttaggagaaatgagataatgatatatggaaattaagcggccaactaaattttgaaactgagctagacattagagagtaaaaactcctgtgaagctgaatttaagctggtcaccctggggaatagagcaactctaatcctgaattccagacagtaggtgtatagatggaaaagaccatggaaaagaagattcaacctaaagttgggaagttttaattggagccctatgaaaaagaccctggtggagaaagggcaaacttgaatatggagctgatatttggaaaaattctcatagtaactactttttctcaatggcaaggcttggactttcttctcaaaatacagatcttatatgtgttcaattaaacagggacagattaggttcaggaagaattattcacatggaatcaattggtatcagagagtcaaccattagatcttagtgggaaatatctgcttctcaaagagaagtcttttggggaaagcaaattaaagtcagagattaatttgatgagtttaggtaatataaactaaggggccaagaaaaaagcttgctcatggtatgaaactagagcttgaggacactgatctagtctatctatactactctttctgacagacccctctcttcattctcatgctccttgatggcccaagccactctctcagttttttaaaaaattgttttatcaaggtctctggattcttcatgggaatgacttccagtttatattttttggcttggttccaaaaagctatcagctaaggaatgcatatacttacttcccctatgggtaaagtaaatgagaattttagaagccaactcacatttttagcctgtacagaatctgcaattcaccaagctacttctgactcatgtctataaagttcttccctgttcttttctcacttcacatgtactctttgcaagaattcatccacttgtgtagtttcagtctgttgatgactacccatctataattccagctgagaatgatcttttgagttttagacatgtagatcctgctgctttctttcgatgttaatgtcccacaggaacttcacattgaagaggtccaaagctaaactcatctttgccttcttccaatctctttctccaaatgcaacctacttctgttgtccttgtcttagtccttttcgtgcttccgtaacaaaataccacagactgggtaatttataatgaacagggatttgttggctcatagttctggaggctgcgaagtccaagatcaaggggctggaatctggtaagggccttcttgttgtgtcatgattccatgatggaaggtggaagaccaaaagagagaaaaaatggggccaaacttgtccttatatgaaactcactcccacaataatgatgctaatccgttcatgaaggcagagccttcatgtcctaatcacctcttcaaggtcacatttactactgttgcaatggcaattaaattttaccataagtttgggaagggaaaaacattaaaccatagcattctgcccccttttccccaaaattcttgttcttctcaaagacaaaatacattcatttcatccccaaagccccaaaaatcttatttcagcataaactcaaaagtgcaatctaatataaattagatatgggtgagactcaaggcacaattcatcgtgaggcaaattcccttccatctctgagcctgcaaaatcgaatcaagttcatcccctcaccccctacccttcccagcatcaggtaaccaccaatcacagaaagttttactgatagtcctgctctagatcatctttgtctatgttcactttagctatttatcctagtgttccattattggaatactaagcatgtgggaattatttatattctactgttcaaggtcctcaccaaggtctgattgcaaaaattcaaaaaattgcaaccttaggcataaatgggttaagcagtttagggtacatttataataattatttactgtgctacttcaaaaatcttattgcctctatttataaataaaaagtgttgtctctacacagtggcttgttgtaatgcatttacttgtttctgcctgattttttctatttatacattttcttttttatttttatttttattttttcacttttaagttcaggggtacatgtgcaggtttgttacataggtaaacttgtgtcatgggggtctgttgtacagattatttcatcacctaggtattaatcctggtacccgttagttgactttcctgatcctctcgctcctcccaccctccacactctaatagtccctagcatgtgttgttcccctctacgtgtccatgtgttctcatcatttagctcccacttataaatgagaacatggggtatttggttttttgttcctgtattagtttgataaggacaatggcctccagatccatctatgtccctgcaaaggacatgatctcattctttttttatggctacgtagtattccatggtatttgtgttggtctcaaaaactacaactatgacaggatggcattttcacttttgttgttatattaaactcatcttaaaaaggaaagattaataatgtcaatatttgggttatggagaaaaagtatctcatatctttgaaaaagttctgtaactatagctttttaggtaggagggattctgtggaaagttttctgattacatcatttctcacagttcaggttagacaccattttactatgaaacactaatgcattgcctgcactgagactttcagtcacatggagaaacctaggcaaaatttttgtacacttggaagaatatttaaattagtaataaaatctttagttttaaactgttgaatgttaaataagatataaaatgtacttgaaagaaatttgctttgatatcagacactgccatgttgcagtttcaagacataataaaaaagtaaactaatgtttatattttgctgtttaagtttattaatacatcagatgagtcttcaaattctacagtggcttttgatatgatcatttttacttgccattttatatagaataaatataaataggcatttatgcttaaaaggaactaatctatctatggaaaaaagagaaggctgcttctcaactaaattgtacagtttagaaacccagatctgaacatagattattgttgtgacctatgtaggaaaatatgttgttttccttatcgtagtccttacagagtccatgataacatataaagccagaaatgtgagcctctgcaagttcatttctttgtcttcaatctctgtgaatagatatgagtttgtgaataagataatattagatgtgatattacaaattattgtgagaagcctctaaggattagatttcaaggactgccatctggctgatgactttatgatgacactgtcatgagatttcatttccttatttctgttccaggatcactctttaaacaagaaataagcattaactctgaattgtctgcttgtagctgtatgagggcttccacaactgccaactagccaggtacaaactcatcaagcagaggagatggtccttgcatcagagggttaaacatgcctagaagttccttagctaagctcccagatactaaaaaatccctctaggttctaagaaagattcagcatgtacatgtgtgtacatgtatgtgtgtacatatatacatatacgtgtatatgcatatgcatgcatatacatacaaacacattttcttccataacatctcagtattctctgttctttataatactgttttgtattttaatgatcaaaattaatagttgatcatctgaaaacattttgacctgttttctccgtctttgacaaccttgaaggcacttgtaagtcactctttgcttctctattcctaggtcctttctcatcttcattgcaacaagaaaagagaaaacaattgagccctattttgtgtgtagcaaggagctactctagttaaacactagatctcttttacattctccaacatgttgttttagtaattattctactttcctttttttgggatattcaatttcttctttctttttgctcctcccctttagcaggccaacatactcaagtctccctcatcctaagagaacttttttagtatatcattttttttctatccagctgtacttgcttctgcttactatatcatttttaagcagtagttggcattactgtttcctgttctttagctactagttgtactttgacccactccagtctcacttccccagcaccaccactttatgaaaacaaggacttactaagatcatcagtgactttgtaatagctaattagtgtattttaattcgtccatcttcttgactatattttaacattgatcctgttggtcaactctgctaatcaaaactttatcctccttggttcccagaacaatattatcttgaatatctcatttctctaatcatataataattgtgaggtgcttggcacaatgcctagtgcgtagtaagaactcagtaaaatatcatctgccatcgacaccataaaaattaatttacttactcaacaaatacttttgtatgaagtttgtgctaggtaggcccagtaattggtacttggtatagagcaatgaaaagccctaccctcataaagcttatattcttggaagcagaagttggaagacagacattgacaaataaaaattaaatacatgatgtgtcagatggtcatacacacagtgtggaagaacaaagaggaaaacaagtggagagagagagggaggtggaagaggagtgctgccatgaaaatgtggtaatcaaaaaaggtcttactgaaaaggtggcatttaagcaaattctaaaagacctgaggatgtgggccatatgtataattgggggggaaaaagtagtccaggagagtcctaataagttaaaatgccccaaagcaggaatattcttggcatgttgaaggaaccttaaaagggagatcagttaggcagaaaaggatcaagcgagcaggaaggtagttgacaataaatttagaggggtaactggcatctgattatattggccttttaggcctgtggactttagcttttaatctgaatgagatgggagttattggagggttttgaatggaggagtgacatgttttgtcttatctggctcctctgttacaatagactaaacagaagtagtgagaccattaggaaactgttgtcataattcagtcaagagatgactgtggctgggatcagaatgggagaggtgaatgtggtgaggagtggttggattctactatattttgggtacagagcacaacagattttataatggaataaatttaggtgtgagagaaagagtcaagaagactcaagaatttttagcctgagcaacggaaagatggggtcatcatttactgagatggggaaggctccaggagtaacatattttgggaggaagatgtggatatgttacatttgaaatgcctattatacatctaggagatgtgtggagtagatagctggatatatgaatcttaagttatggggagtagctcaagatacaaagttgggagttgtaacaatgatcagtgcaagttctctgtcttcaatgcaattttaaatgttgatgttccattcttaattgtctctcttctttctctctgcacattttgagtagctttgtctgttggcttcagttaacattaagactcctcagtgtcaacttccatcttacactcttctcctgatctccagaactgtactttctgccacctaacctacattaccacctggatatgctacaggctgcaaaatgtgtcaagtagaatgcattatcttgcccctaaaagaaagttaaattttctgtgttttcagtgtagtgtaattgtctaacttaattgtctctaaaactggaaacctaagaattaccttctacctttctcttgatctctctttcccaatctactgacacatgtattaaactggcttccaaattctgtgaattctacttcaaaaattgctctagaaacaattccctctctttatccctattgtcacctcatcctaaagcctcttcatcctttgtagatttctgggagattgtaaccaacttttctctattctgccagttatcaagtctttacgctcatttgacattcacaacagccttggatctgtcttccttgaaatgaatcttcttgcttccctttgattccagtgctttttttttaccctcctgagacttgatgcatgatatttacatgtatgacatgtttccaaaagcattctcaaatttttctgaaagtaaaaacaaatgaaaaagtaaaacattttcctgggaagaaaagcaaatagtgttatacatttttgcttgttcatttgtttgtttatttaggagagggacaagcattagaacttcataagagtcttatatgctgtatctacaaataccgtcccttggcaatataattttagagttccttttctggaactacttaaggactgttttatgatcctcagcagactgttatattattttatagccataccttttatttgctgagtaattgtactcaataattgtttgtaattgaatgaaacaattcatcagatgttgggcactgaatggctttggattatttccaaaaatttaaaggataaagatttgctgccttcaaagctatgtacaaaaatatgatagaatgctagcgggatatttgtttaaaatacaacctttattacattggggcctgctcataatatatatgtggcacattttatttaaaatattaaagttcctggtgggacatgtccccataatcccagcactttgggaggccgaggtgggggtgggaggatcactagaggccaagagtttgagaccagcctgggcaacatagtgagataccatttctacaaaacataaaaaaaaaaaaaaaaaagccaagtttgtagtcccagctacttgggaagctgaggcaagaggatttcttgaacctaggagttcagttcaaggctgcagtgagctatgatcatgccagtgtactccagcctgggtgacgtagtgagactccatctcttaaaattaaattaaatttaaagctacaaatgaccccaaagccaccagttcaaccctctcaattttgaataccctattttaaattcctcttatgcgaaatgtaccttgtagtccattttaaggactgagaggatttggtatgttaaaaaattcaatccattatcaactcctttaggtacacttagcagtatgaaaatgtgtctttcggctcttcaggagagagtcatatgtatagttacaagacaatcccatttttatattgctgagacccaaatcttcccaactgattatgaagcataagaactcttcggaggtttaagtgagctgagattgtgccactgcactacagcctgggcgacagagcaagactttgtctcaaaaaaaaaaaaaaattctctgcattctacagtagggtaatataacatctatgatgtgaaatcttggggctccgggccagagagtgtcatgatccatatggatctaaaaggttcatagtggtaacagcctgcttcattttatgtcatctcctttcaagtaattagaatgtttctagcttgcagggattgcacacaaagggagacatttggaaccatgtcattggtgatttactggtgtggaaaattacctggtgatgtagccaagtagccattttcattctaacccagtcctacagtcctgaactgggctgaaccaacgcaccaaaatatatgcttagaaatgctcctatgtatcagttttcccaggaaaaacaatagtattatcgaaaacttaccattgtttcctaataaaaaattataggataccaacagactgttttttgttcataaatttaatattacagtatcaaatattaaagcaaatgggagaaagtttttcttatttggtttaattgaaccattaatgttagctacaatacccatcatgttacttttcaattatatttatattttcattttatttctatctgtatcattctcagaaagacttctttaaaacattcaataaaaatagaatttaggtagatttatttttagaaagttgagtttttttaataaatgaatataatcatcacttgacttaatttttttctgcacaattctagaaatcttatagttttgggatcctttggctttattcagtatgtaacagggatctgtttcctttctctaaatcattaattcaaatgatttcttatattaaaaatgtttggacatataggtattaatgagttttatgaaatctaatctttccaatttccccctaaaaagggatgtcatttaatcagttctaggttgtgatcaatagcagatttttttttttttttttttttttttttttttttttttttttttttttgcagctccctttcaccccgtagggaaacctgatatcatccttgactaattgcagcaaagagcctggctcaggtcctttgtcttataccgagtgtttatagattcttgagcccagcagaatctgaactcctggctactgctacctacttcccagcccaggccccaaaagccctatgtctgcagccccgtgcaccactgtgtgtttttgtggcatttctgaaacacagagctacttaacttgtttctaagcccagattgtgcctttttgattttctattttggtattttatctaccatttttctgtgtttggatgtttcttctatattttgaaataacttctttcctttagtacaagtgattcttattgtagaaactatcaaaaatttacaaataaagaatcattctcaacattcttagcaattccttctatcatatttttgcaaatatatttttgcctatttttattttacttactccctgtttattaacagttaaaagcattttcagatagttttattttttcatttaaaaaaatcttaccacatttttattaggaaggaaatggacaggtgtttatcttttcaataaaaaacatgggggaaataatttcttgaagtacatagtgacattcttccagccaatgttttatgctgtggtcattccgtctgtcatcagtattcatagaaagagatgaaaattatttaaattaactaggaaatcaattccccattcaaagcagtagttgtgtgtttcaaatatcttctaatagtcagtttcacacttagctttatcaaattcctaattatgatactcattacatcactctgtgtccagtcagtgtgtttatgccacagagcaattaaagcaaatcaggtgaaccaaattcaatcacctttgtagataataacctacgttgcttaaacttatggccgctcatacaattactgatggattgcctttttcttttatattgccagtattttaaatgtcctagtgaagttggggtagctgttgaacttcaactttatcacaacctcttttttaaaatgtgtaaacgaaaaaaccctccatgaaatgaccaaatacagttttcatgctgggacaaattagatgaataataatcataaattcataatgattatttatgattttatgtttttatagtgagatatgttttgttgaaatgtgttatataagtgatacttaagtttcctattaaaatagaaatgctaaaatggcattgttctctttagctgtgagtctagcttttgacctctgcttaaacggaactgttgttccatcccaaatctgcaactctgaggcctatgctcccttcactgctgtctaatggatacctatcaatttggaaggaggtttcaggcagctattcccggtaatctaatctcagctctgtccttttcaatattttcatcagtggcttggatgaagacatagataacattcttatcaaatcaatgccacaaagcagggagaaatagcaaatatagcagacaagagtatcaggagccaaaaagttttcaacaagttggactggtaggctgaatactgaaagatgtaatgtaaatgcaaggtgctacatgtgggttcaaaagaaacatgaaacaaaaaacccatctaacttagactgggctccctggaaatagactaagatagagagttgtgtgcataaggtttgttgaggagtgttcccatgagatacatgtgtaaggttgtaagataggcaagattgcacagacgaagaagtgcagtgaagcctgcagtgcgttgcggcctcatcagattttcaggggagttctggaaattgcatggccctttagagacacgctgaattgaagcaagggatctggacctttgaacccaatactagagagttaatggtcctgggtcaccccatgggaaagagcagactggagtaagattgttacctacagctgaaggcaatttccagggagggaggcagctgtgagctgttagtagtcaatattccaaccagctagggcatgaggtcttggcagagcaacagtgtacccaagaccgcagtgttacccaaagtatggtcctctgactggcagcattggtatcacctatgagctcactagaaatttaaatttgtaggtcctaccccatccaactaaatcagaatctctggggatgggacttggggaacttttaacaagctttcaggcctccaagttatttctatgcatattaaaatttgagaaccactgcctacaccaaccaaaaacattccaaatatggagataacatagagtttttagcaacaataatctccttctgtttcacttctctctttacacacacacacacacacacacacacacaacacacaacacacaatgtgatagaacagtgggaaaggaaagccaaaggggatcttaggccgaataaatttaagcatataacctagtcctaagaacgtatatttcagcttaatagagagaggaatattgttataaagctgtccaaagatggaacaggctgccttgtaaagttgtagaagtattcaggaacaggttggtgataccttggtggttgtatggtataacatcctgatcttcacatactcatcatctagagtgggagttttctttttccaaatggggttttggcagaactagttccactgtatcttaataagtaataactcaagaaagggttctatggatgaaaaaatgattaggtaatatcaagttaaatcaaagcgaacagacttctttcccataggagtaatcagacccttattacagtgcatgcttggtgaatcaacaaagtatgtgtatttatgaaagtatggggggaagggataatctatacagtatgcatcccttctaaaagtttgaccatgaaaacaatttctcaagaatcttatacaacactacagtatctggtccaatactatgcatagaacatgcactcagtaagtgtttgtaagatagatagcatagcatataggccaggccactgaagggaaatcatctcaccgtgagttacctgaatagtattctctagtgccattagctcaattcttcacgtaggcataagcctatacatttgccatgctaaccaagggaatttgtgttacgtgaattttgactctattcagacatttttttctatgactcctccaaggctgttattcttacctcatattctggtagaagtttaaggacttttttctgggaatattgattaattagctagctagctagagacagagagaggatagagattgattctctggcagagcctatttgaatcatattgaatctttttttttcctgagacttcccacaaggaggatggaggagaaattttttagaaatccaccgaagtaatcagggatatcttcagtaaaagaagctatacttaataaagtctctattttagcagatggcaatcaacaatagaggcaatagacaatagagtctattaaaattgctgggatctgctaataacgtttttcttttccctgaaacaaatgccattaaccctccttgacactctgtcttcatcaacattctaatagaatggaagtaactcataattttgaggatttttttcccacacaaaacctataaaccacaccacgctagtgattacttttagcctagttgctaggttgctgctggtaacagtaaaacttatcctgacaggtaggcaattccagaagcccagccaagcacttggtgtgtgtgagtaaacccccatacacttctcatgtagagtaaccctggccaacccataactcttagcaactattcctggtggacggacctggtctactctaagaagaggccaaggttctttaatagtgcagttgcaagaaccagaattgaaagtcaaagttctagcaagattttgcagactccttggcaaaccagtggcttgggactcattcttgacttcaagcccttaattgataatggtaggacagcttgcttgcgctgggttctgctccctgggatatgcactgtttgccaaatgagtagcaggtggacagacatctttacaatttgctgtcccatattctaaatgaacgtgacattctataggtctgagttaacctatgaagtcaccaatttcaatatcaaaatatttatgacagagaaaaggatactgaggcacagagagtctgtgactttcctaagctcaaaacaccagtttgtgttaattctgacacagaaattcttgtatttgctatcagtctcctttttctgtgtgtgtgtgtgtttttacattgcagcatcacctatatgatgttaggttctgtaactttttgagaattttctcacatacagtgatgtgttactttttgatatttcaaatagttctagtaagtcttttctacttttattagcgtattaacatactggctctaagagggcatctcaccacatctttgccattcttcctggaaaggcaagtttctctccatcttcttttttgtattccaaagttttgccaaagtttgcttttgaaaatgggttacctggcagagctttattattctaactttgaaagtacaagtcagaatcagacagtggcagttatatatgcactactgtgattactatataatgaaagtatctatggtgaaaatactgatactgacatatatttgccattttctaattaagtgcttcagtaaaaattaagcactcactctttgccagatactgcaatagatattgagcacattgaacaaaattctccatatacatatatatgagtccacattctatgaaagtataatgtttttctgagaaaaggcataatattctattaatatcagcttttgcttcttccaccatatattgaaagaattctgaatactgttataatttaatgggagaatctagagaattctgtatttgctttcactgcattgatgaactaagatttttaaaaaatgtattcttcatagaactacttttccatatttacctaatattattcttatatcatttgagcacatatttcactaacaaaacaaatgtgcaatgttattagttctaacatcaaaattacactgatactttaatttttatcctattatttttcatgcagattaaaataattatagctacatcacatgttgcaagttttaagagctactttaaaaatatatgcttcaggaaagacatgattagatggggaaatggatgatgttcatattttcaaatgaaaagttttaaaaaagtgcctatcacaaacactaaatttttacataaattatcaactactaatatatctacaagaaataccatttttccctacaaaaactcttaacaataattgttaaacttagtcctggaacctgctaatataatcggacaaatgttgtcaataagaaggtgaaaaagaaagcatatatagtttatcaaactataaaatatagtttatcaaaaccaatttttcctattgacatttattcaggaaggaaaatggatgagtgaaatgaacaatggtctctaagagaggtgggagatagcaataaattcagaccacgtttcctgtcattacagcagggaagtaaaagagctacagtcaactctcgaaagtacttgggggaactaatgattccctgtagacctgtgatgtttttgaaatttaattcaacaatttgatatacaccgcaaagcgaacagatagtcagatcaaaatcggaagaacgattgtctgaatggcatccatttttcctagatgtgctgtcccatcctgtgtcaattaaactttcaggtgatcttcaaacatatttccaagtaaaaggtattgcagttatcctataaactggcctcttccccagcactgcttttgctgtggtcaactttatttctttgggctcacaaaactgatagagcaaaataaggaaaacggaacattggattaaaataaattaattcccattctgtgactcactaaaaaaaaaatgataactatgcttctgtgagcattaataaggaaatgaataaggaaatgaccaaattgttcagtggacaacttgtatgggatttttaagtattgtgtcatcatcaatgttgtcaattagcatatactttgaaatcaactaaagcaaatcagttgactaatcattaagggtctttttaaatgacaacatctaaacagcaaatgttttattttggaaaatcatgacagcacaagaatgagccagatgttttacaacatgatatccataatttaaagtatgtagtagtcactcaaaggatttctatttcagtttccttatgatttggctaagctagaatttggaaaaacactttaaggtaatgtgagaaacagcaaaattcaacatgtggattttttcactaaagcttatttctgattattttttacaaactttactaggtatatgttaacttcatgacacttatagcagtggaccgtagttttaataaaatgtgaatgtatactcttttctcaataatattaaagaatgttgactttcgtgaggatatttttatttttctcaacattaagaactgtcaaagatttaattctacaacagaagacgtgaattttgttttctaaaggagaacagaatctatagaagaagtgttgctcatagtactcagattgttgaccaatcttaaaggagaaaccgtcaattaatttaccgagaagtaataacattatctttttcttcaattatgcacatccacaaagatttggggcaaaatccacttaaatgatattatacataatagatgagtattcatatgttgtaagagtcctggcttctttcctgcaaaatgattaaaacttggatcagaaaccaattaaaaatccattctaattcccaaatgtatgtaactgtactataagaaaaataaatatttcttcttgagggatatccattagttaaggatattcataacatggtgtcttgtaggaaatgttaatctttgggtgaatagggatgtttgggaataacaagactcaaagagatgttgcacttactcacttttctctgagttgttatttctgtcatttccccagtgcgcctgtcctcaactttgcctctctccttattcctttttttttttttttttttttgagacggagtctcgctctcttgcccaggctgtagtgcagtggtgcgatcttggctcactgcaacctctccctcctgggttcaagcaattctctgtctcagcctcccgagtggctgggattacaggcacccaccaccacgccctgctaattttttttgtatttttagtagagacagggtttcaccatcttggccaggctggtcttgaactcctgacctcgtgatccacccaccttggcctcccaaagtgctgggattacaggcgtgagccaccatggccgatccctccttatttctttttatctctacctctgcctcaatggtatttctctattactgttagcatttgctttctgtgagctcttgcacactgtcagcttatatacatgttcctgttcacatgttttcctgtccccagtggttacaacatgtcttctatctcagcccactctagaattgtcttacttttccaggtctcctgctcctcagtatttttcccacttttctagattcatgttttcccatctgcatatttctcttccatgtctgcactgtcatccgcttagaagacagcgcataaggacactgttatctgagcaaatcttcagcacagccaccatgaagcatggttaccttgtcactttccatttttcccatagtgtgtgcaaactgccctgatctgcatagaaaggtatcataattgaggaaacaaaatgcacaaaaatgtccttggttattccacccctcagaaatataggagagaagtaatttacagaattacacagaataacgctatgtcacatggacatggagttatcgggttagcatataattggaaaatatttcctaggaccttgacatttactcactttttgttttcaaattacatgtccctatctattagttgcaaattattttaatgcaccgtttaccaaagaaaggctgtttcttctgaaagctttcatttgacaagtaacttgtaaaaatattcacattgtgtatctgttttccccttctagtccaaactctagttatcttaaactttgcgcagttataaaaaatcataacaaaaaaagcttcctcgttgtcattcttgtcaaaacaggtttaccagacttaggtaaacttaaaatagttagtgtaaaagttaaaaagctgatttgctccttccagcgtgtttgttgcctttttgccacagcaaaattgtaaatgtaaacgtattccctaggagatgagctgggctgcaattttcagctaattgggagaagcagccctgagttgagcactgtcaggctgatttgagtcttaagatatgatgatgattattgtgtcaaatgtaatcaagaacgtgggctctgaactgactcaagggctggctgtttttaattcaggttcgtatatgaagtagacctccggttcaccgatagtcacagctggttgtagaagagagcaatttttaaaatgctatttcattctctatggagctctagggatcagagattggatgcacagggaggggacacatcctcattctctcctgaaaaattctattaattttcagtataataaactttctcttgagattccccagtggctctgtatcggtggttttcaaacttctcagacccaatgccacccctcttttcttttttaaataacaaatactttgtaataccttctttacgattataagccaaaatatgtagacaacataccctacttatacaggcaatagtttaaatgatgccgtaactctattttaaagagaaataagagtcatttataataaaataatatgtgttgtagtatgcagttattcaggcaggatcacactggaacacaagtgaagtttttagatcacgagactatcaatgcagtataaacaaatgcagaatgacaccattgtgttgtatggagactcaaataccatgaggggcattggtcatccatagcgtaattttccaaaatgctgaacaactcttggcaaaattcctaacaccatgaaataaattttttcttggatcgttatggcagttagttgcatggctgaaaaattcaatgtcttaaaatcatgaggaaaatatcttatgtttacgtgtaaaattgagttacgttccaggtttaggtgtttataaacagggtttccacatacatgcatgtccagtgggatattccaaagtgctgtcagacttgggagagttctttgttgtataagaagtctaccatcttcattccctctccacagaatgctattatagtaacactcttcaatcactgtgatagtcaaatgtcctccctcaatttctaggatgcctcttttttttgtggtctgtataatttggttaaatatctttccagacaaatactgatttgtgaattaatgaaatagcagtattttcggagcacctaacctatttctgagtgatacagttgccatttttacaagactaaatgaaattaccatttcagacctgccagattgtctagcccagtcttttacaattctgtgattatcactgcaattataatctattttcaccacttgaatggcatgatctctataaaagggtggtgataacactcatctattctccttcccctcacatagctatatcaatcgccccctaaccagttgttgataaatgcagttgaattttatgtaaaaattataagagatattattgtagctgtccaagacatttaaaatgctaaatgcaacttacgtggaggctataagagaaatatgaacccatttattgaagagattagctaatttagtaaaacaacacagatatacctgcatacagggataaatccctattgtctaaattattgagataaaataatgttttacaatgaaaaacttttagacaagtaggtaagtaaaatgcagcagtctatttgcatttcatctgggcatttgacaaagtctttcgttatactcttgtgaataagttggagaaatactggctagatgcaagataaattggatggcttagaagccacttcatgattttacgcaaaggatgtcgattaatagaccagtgtcaggtggtgatggaagatctctggtgctatgtcacaagcttctgttctcaaccctgacacactggatgtttttgacagaacatgagtagaactacagagaggaggcccatcaaacttatgggtgataaaaagcagggagggcaggagtattttgggtgacagaagccaaatgggtgtctggacaggatgcgttttaaggcacttttggtacttgatgtctgaagaccaggatcaaacttataggcaatctgaacatttgccaaaataacaggttaattttgacagaagttattatttgtatgctgtctatttctttaatacacctagaaagtattgaaataacattttttgcagacactcattttgaaaattcagaaaaaaaattgttaactttcgtggaagagtaacagaaactcagtcattgacagctaaatacaatgtgttgcccagtaaaatagtccaccccttcactttcatggctaatataaaatttgatgaaagatacaaattccaaagattgaatatctgtacatttgcaaagcaaaacacaattttgggcacagaattgctcattctcatttttaaacatcttggttataactgaacaatagttttttataacaaagataatattttcaaattattatgaggttcaactgaaataatttatgtgaaagcaatgtctaaactctaaaattctatataaatataaattattattcaataaattcacatcaagaaaattttaagttttttaagaacaagagcctatggccttgtttttagaagctgtataccttatcggtagtaggtttattgactttaattaaatttattgagtatctattaaattgccaggaactgtggtgtgaatctttgccctcaaataatttacagtaagttgtggttgatgaatggtgatgacgatgatgaatatccagactatagtaagtggtatattcataagtcagaggattcttaaaaccagatgcaccctcagattcattcctttcatgttgtacttctaattgaaaaaaataaatcctaaattatgactgttctttataaattttaattgatcttataaaaggccatcaatacatttcaaagtatctaggtcttttaaatgcaatttttcaccctggtaattaaaagtacgaaagcaagaaactttaaatctttattttgataagttttaattagctcaagctacttgtaatcccacatcttgtcttgtaaatcatatctgagccattaaaataggtttacaattagaagggcaattcttttagaatctacttaaactaagtcacttcgacaaattaattcatcgttcagttggttttattaaaatgtatttatttcactgtaaaatgtctagtaaagcaatgtatgaagtattttattttcatgttagaaattttatgtaaaagatatcccaaaatacatagacattcagatactctctgtatcattaaccaacatttactaacttatcatttagagaaggccaaaattgtatgtactataactttgtataatttcataagaattaaaatattcgattaatgcctgtaatgccttctttctaaatcaaatcctcaagcttacctcgagttcaaagttcagtatttattgtaacacatctcatagatgacggatgaagatggtaagcaaaggaataataatttcttttctcttttcacacatatatacacacataccccataatcctaattcatataataataacagaaaacaaagggcttttgagaatagtgacatattaatatccattatatttacttcacagggagactggcaagtctaccttgagaggtaatgtcttatagtacagtggactagattgtttcaagatttgtcatttattttggcaactcacccagcttccctgaaagttaagttcctcatctataaactgttcatgataattacaacctgcctcattagcctcatcaagctatttaaaatatgaaaggaggtgctatctgtggatcctgtcaaaggagcttgaaaactgcagaacattattttagtgtaaaatactataacaatacatgttgaatataaaatggctttttcttaacttttattttaagttcaggagcacgtgtgcaggtttgttatataggtaaactcatgtcatgggggtttgttgtaccgattattttgttacccaggtattaagcgtagtacacattagatatttttcttgatcctctccctcctcccaccctccccactccagtaggcttccacgtctgttgttcctctctgtgtccatgtgttctcatcatttagctcccactaataagtgagaacatgcagtatttggttttctgttcctgcattagtttgctaaggacaatggcctgcagctccatccatgatctctgaagaatctccacactggttttcacaatgactgaaataacatacactataaccaacagtttataagcaatgctttttctccagaacctgttatttttgactatttagtgatagccattctgactggtatgtgatggtatctccttgtggttttgatttgcatttctccaatgatcagtgatgttgagctttttttcatatgcttgttggtcgcatgtatgttttcttttaaaaagtgtctgttcatgtgctttgctaaaagggccctttcaaatgtgtattattaaccacaagagagtactgagtaagagactaggtaataaaagtcacaaatatttcgatatcataattcagaatttagatcagcggttatgaaattgttcgtatttccaaattccactgacaggactctactataagtttatttcatctgttgatatgtttttagccacttctttcttttaaagtgaatctgttgtgtgtttgccatttgatattagaaaactgaacctgcctgctttgctgtcttctgaatattatgtatcaacaactaacaagctacagttagttgttttgttctgtttttctctaagttattgtggatgaggatatatataactgcacagtcttatcaggtttgtaagagatgatcttaggctcatcttttaaattggtttttatactattttaaacaaatccttttaggagagaagaaaagctgcttagtctatcaacattaggaaatatatctttaaagagtttatcactgcaagtaaccaaagccaacttaaaaattcgcattatacaaatcattgagaatttatttagaacagaaatgtgtccaactataggtcaacaccaattttaagtgtgtaattatctgggaagtagtgttaactgcatttttttctaaagatcccttacagttgtataaatgcccaaaaggatattttgagtctctgtatattaaccaaaccaaatgtaattcattactcccaacattatatttcaacctctccaaatagtaccttttcgtattgtatcagcagaaaaatataaaatgcagatcttaaagagtatcaatctctttaaaaattcaagaaagaaaaaaatatgtgtgtatagagacgtgtatttcatctgctcataacactgtgtacatttctttatcaactaatttttttcagtgatttatgagttgaaatacaaatcaaatgaaacgggtaatgcaaagtaaagtagaaaacacattttctactgctgtctcctaatgcaggtcttttcaggaaagtactaatggttttagggaaagtgtataattatggttgtttccctaatgataaattcgcaaatctctattttaaaaacattcataaggttaaaaaaatgagagatgaaatgtgtctttcaaaattccttacgtgattgataatgcctatactctcttactatctaaagtctaggtgatatgtatattttttttaaaaaataaaatgtctgtatcagtgaaggaagtttacacagatagcttcaaagctgtggtttatctttggaggattaatctatttctcatgccagtgtgttgctactgcacatgttaaaaagtcatcctgtggtgtctggggtgacaaaagatgggaatgagttttctgagaactaatcagcaatactttgggaacatttaggtcatggtttccaattaactctggagagtttgagtaatttagtaccagacctcaagagagaggggatgaaaacctcgttaattcatatgttggtgaacggcaaaccagcaaatttgcattaaaaatggatttttattttaaagcaaagagcagccagatcttttctgcaatagtttgggtaggagaatatctttgtatgtatgtgttcccttatgtgtaggtatttgtatgtttcaacgaccctgcatatggcaataacagaaaattaaatttgtgctctaaaatgaagaccaggattcagtgacataatcttccttgtgcctttctttcttttagtacaatgaatatatcagagaggagtgtattccaatatctgtcttcagagttacaaaaacttcttttctagaatgcaagacttgggctatacccccagctctgccacttaacttgtatacaaccttgggaacatcattacaattctctcagaatcaatctctccagccctaaaatgaaaccagcaaaagcctgtactgtatatctaaaaggttttttatttttatgaaaattagttaggcaaacttttgttaagcatccatcactctattttgagataaagccttgctggatgatctccacctcttttgatggaaagagtaaaacatgtttaagatacatttatcacttgtttggcaaattgagatagaagtttatgaaagcagattgatatatgttacatttgagctactgggaaggactccagatggtttatagccttaattacattgtaactctagttaaatgtttacctatctgtaccctctgttaaacttgaatatgttaaataccaaagtccatgtattattggattttctgtcaccatcatcaggcacagatcctggtacacaataggtacggaatggatgcatggatgaattattgaattagatgttggtaggcatgtggaaataagaatgaggttcagaattaaagataatctgtatcgagtgtaaagccattggcagagaatgaaatatccagctgagtatacatagaaaaagaaggtaggtagaaaaatggaaaatatcttatgaagtgatgatagaataactctgaatatgtttgaaaacatataaagagttatgtggatgttagctttaaaaattatcttccatgctgtacattagatctgccattcttcatgctgtggatgaaaagcaagcatcagaagttaaattaaaatgatgtcatatattcctcgccttacagtttcataacagaggagaaaagagaaacattctctcattgccaccacccttctccagtcatatttctaggtagatgttgcccaaaaacagataaaaccacagagttggttttgctaggaatggactactaatccaggcaatgttgacagcttttgcttctcattagtgcacgttactaatagaattgctagagattaaaaggaatcctttctacaaagtgctgtatatccataggtgacaaaattctagcttcccctcacaagtacaatataaagttatgttttaaaatcaaaatgcaatttactagcaaactagtaggaactgttatggttacaggaaatttgaatttcagattaactctggttctatgagtagcggttgatatggcaagaatcattttgatcttacatccaggtgctactaaggtctctctgacctatatctcaccaaaaaaaggaacaaaataatgatcctttaatctttctcctaaaatatcataggaaatgatagtggctaaattgcaaataaactaggaaggaaagattcagagtattttatgtgattactctataacaatgccaggccatagtgaaagtgttatttagcagaagactgagttctttgaatgttcctaatttatcacattttaaaaataacctgggcaaaataacctttcatatcagattgagcctttttctaaaaatactcaatatgtttctgtaattatacctacacacttacaattccacagtataatgcaccgataaagtatttttcatccatatatctaatagtagaatggtgtgtatacaataattaagctctttaggcttaccccggaaagcaacaagtttcccttcctttttcctttttatgtattatgttggccataagaaattgatgatattcaactcaatgcagtcttagagatttattcagaaataccatggtgtgtgtgtgtggcgggagtagggttctaatgacaggtcagaacttacttatttgatttcttcattgataatcaggtcttaaaaagaaaatgggtatgctgaaaacatgccttctgtgattctttaccttcatgtgcagttgtctctggataaacactttctttggcacgtatagggttgcactaagctttatagctccaacactccgccccttcagtagattcttgcttgtaactgatgataatgcaaacctgtattatctataggtctccttaaagggcaaccaaaagttcagtagcaattcaggcacaattactgcatgtgagaatcctccatcttgttccctttggagaccacatatatttcttaggcaagtatatttttaaaatccttgttcagcatgacaattcaggaggtcaagttctcccagaaagcagattctgagaaagtgattagcatgaaggaattttattggagagtgctctcaggattaacacctgtgagcggaggaaaggaaagggagcaggattgggcagaaggagaagctgggctaccatacagtcacaactacaacacaatcaaccctccgcctctccttcctagccttccccaggaggatctctgaagtctgaaggtagaatagcccttcagaattgtcctgagttgcagcaagggacccaggattttataccccacaactctcccatcaaccaatacgtgcagcccgtctcggggacatagtgggtaactttgggctaggcacctctctttagctgagtccagctctcagacaggaataacagctgaggactgtcagccagtagcactaccagcagctggggtcagaagtatttcagtcctgaaaaggggtccgggcagcccagcttagcatctactatgccagtcgttctcaaatctggttcctggcaactgtgattctcaagctttagcatatattggaaggcttgttaaaacacagcttgccggattttacccacagagtctctgattcagtagagctaggctgaggcctgggaatttgcatttctaataacttctcagacgttgctggtgctgctggtccatggactatgagaacactgtttcatgctgcccttatttacatactgagaatggtacacagtgctcttatgaatagaatgaaaaccttttgaaatcacattattccttactccatcaaattctcagctatttttgtgcaccataaagctggaatagctgattataaaactttgttatgtaaaaaagtacttaaccaatacagtagattctgtttgcaaagcattattacagtttctaatatctggtcattgttacttgtaaaattcagccaaattttctccagggcctgtagtttgataacttggacaaaggaatttaaaaaaaaatctaattcaagacctttggttttttttctgaacatatcttttttttctttatgattcttatttttacattttacttatcatataagccacttaaacccatatggttccggaaaatttaaaactatatgatacatttagagcatgttgaatgcacagatatggaaattaagtattcttgactcattctagactagacctggcacaattaaaatttagggattcaacgtacacacacatagattccgagagaaatgttgaagccgtaaaacccccacacaagcaggaaacaacagtcttacctattattcaagaggcacgtaaaggagctcatttgaggagattttctgctgttattgccatcgaatttttaacgtattttccaaattagaaaatattcagcctgatgttgtcaatatttcagaccacaagggtatcatttaggaaaatggtttcttactgtcctgaaagagttactgttcttccctaagggcctaatttacaaagcagcaaacttgctggtaggatttggctgaaaatcacattgtctcggtagaactctttcatctgatttatgtgcattgcattttgcaaataactcttggaaagttatttactagttactttctctggaagcagagggtaagcggcatttctagtttaaggatagaggagctaagatgcatcaagcgcagctcatcatgaagctgatgctgataaaatgcacaatattacattctctaagtttcactctgccatgggagaatttcatatttttaaattttgtttgaaattggactacattagaaaatatgtcaaatgtctaaccctgcatttatattctggaatgtgacagcttatttctgttccaaattttgcactggagatggagtaagtcttaatgcaaactgcatgaaactgccacttttataggtcacacccagtcaattgtcagcagttacacatggttcaaactgtaaggtgtatgcccaattgtagcattgagattcgtggagttgttgcagtggttctgaatttttcaagcatgatacataaaaagataaatgactcttttgatatttctccttgcattgatagtttgcctgaaaactagataagcagggagccggcagtccacgttagcccttgaactacatgaggtttaatttatttgcccaaccagaaccctacactacctttcagctgtgcagtattaaagtttatttaggagttgataaatagcttagtgcaatgcttccttttttccagtagctacatcctcataaacctattctaccctccaccagttaatgcagacagaagatttttatccagtatgagcactgaaactccactgtggaagactgtgtgctcagcaaaaacctcacccatgatgaataaacagctcttccgggggctttgctgccgctggctcggcaggagttgtttattgcctggtttgcacatcccatgataaagttgctgctgaaataaattgcagttttgcataattattgacaatcacatcttaacaagcaatgtgtatcatattcaagtgttcaattttttaaaatccatttttagcttatgtttaatcccagaaagtgtttgtgtagtaatagaaggcaaataagacatttaaatagagtactaatttcctcattgcagacaaagtttacctgaatctttttccataggactgttactgcctaaggcaattttcctttctaagctattattatatagatatttgctgagggcatatgtgtgtgtatccacaatacatgcattttatatatatatatatatatatatatatgatcaaaaatatgaatacatttttagagtttttgtcatgaaagagtttgtttcatctttttaaaatattacaggaatggggaaatgggatatgggtagaaggaactaatgtttttgagtaactgtaatgtataactgtataacgtggggcactcaacttcacaggaattttttattttaattctcatcacagcaatagatattgcagatgagaaactgagaatcagagagggaacttgccatatcacgtaagtggtaaagaacactgggaattgaactcagatctgcctagtttttaaaactctactctttttcattacacataacatttttattttggaaaatgttctcagttgtatgatcaagtagttaaatatgaaactaacacaataattataactgatgtcatgcaaaatgatagtttgcacaaaatgatagtttctatgaaatgttatttctttacttgttaagtctttcttcctttgccctccaatccccttctttttgtcttttcctctagtcttttccttttgattctaggtttgtattttcttgacttttctccttgcatatcaaatccttgttttctgcctcagagcagcatcaaagacaagcatggtacagggattttagggttttaactataaaggtttgtctcaaatttggcagtatattaaaaataagctttcaaaattgaccaacaaaaactacaaaattgaaaaaaaggtactttgaactttcacatgttcaaatatatgtatatatatttcacatatatatatgaaacctcctctgtggagaggggtttatagaaatctgtaattgtcattcttgcatgccttcccccatacaaacgcctttaagttaaataaaaatgaaagtaaatagactgcacaatattatagttgttgcttaaaggaagagctgtagcaacaactcaccccattgttggtatattacaatttagttcctccatctttctctttttatggagttcactaggtgcaccattctgatatttaataattgcatctgaacatttggtcctttgcagggtgagtgagcgagaggctgctttggaagaaactcatagattactgcaacagttccccctggacctggaaaagtttcttgcctggcttacagaagctgaaacaactgccaatgtcctacaggatgctacccgtaaggaaaggctcctagaagactccaagggagtaaaagagctgatgaaacaatggcaagtaagtcaggcatttccgctttagcactcttgtggatccaattgaacaattctcagcatttgtacttgtaactgacaagccagggacaaaacaaaatagttgcttttatacagcctgatgtatttcggtatttggacaaggaggagagaggcagagggagaaggaaacatcatttataattccacttaacaccctcgtcttagaaaaagtacatgctctgaccaggaaaacatttgcatataaaaccagagcttcggtcaaggagaaactttgctcagagaaataacttagggattggtttattaaattttaaaagttgacatttttgagtgtttatttaatattttacagggaaagcatctgtatgaattgtctgttttatttagcgttgctaactgaatcagtttcccttcattactttcaaatatgttttgaaatgttaatctggcattttgtagctttcttcctaacatgatctgtgaaaataagaatgagatggctgaatttgtcgtagttaatgatcaaacaattttcagacaattgtttttcctagaaacaaaaattatttccataaagttccatatgcataaacagtgaaaacagaacgtggggtagttttgtttaaatgaagtcttggtgagaatcatattctgtagtacaaggaggctcttaaagtttattctcaatacctgatataattttcctgaactattatggagttttgttatgtatagttggtttttctgacttgatataataactttactagtctctcaaatacaatttggatataaatcattataataagatgattgattttttagactaactttattttttgatatttttaaactattatgaaaaactattatgaaactattatgatatttttaaactattatgaaaagtatattctagtttgaataattccagaatcaaatcataataagcagaagttcttctcctctccctcctatcgttctccttctcctgtttttcttttttgatatgatagttgatctactttgctgctctgttgcatagagtacgtaacagtggcaatgtatggctcctgaatttatcgttcttgcttcatcatcctgctttgaccccactttctcctccaaaatgcgtgttgagttagtttgatcatttggaggtaatttgtttggaacagtatcagactttatagatatctcccatggcttgtgatagaatataagggcaatgcaaatgtagagttttttgctcactcttcgatgtatggttagacaatgtaccactgtaatatatttggcttaggctatttcataaataaaattttattataaaatattataaatgctgataaagctactccagaattttaatagatatgtgggtttcccggccagatgcggtggctcatgcctgtaaccccagcactttgggaggccgaggtgggtggatcacctgaagtcaggagttcgagaccagcctggccaacatggcgaaaccccatctctactaaaaatacaaaaattagctgggtatggtgacctgcgcctgtaatcctagctacttgggaggctgaggtgggagaatcgcttgaacccaggaggcagaggttgcagtgagccgaggtggcgccactgcactccagcctgggtgacaaagtgagacttcatctcaaaacaaataaataaataaataaaaatacatgggtttacattttacccatcagctatggtaggtaaataataagctttgattaagtctattttagtctatttttagcagattactttgaaaaataaagaataacccaatgactaaaaaattattttatgtcagggatttaataaaacatatctttaaatctagttgagggcaaaaatacgtctattttctactatacaatttgtatttatatctgctgtattatataatgaaaatttatctctatttctaatctcaagaaactgcaagcttctgaatcattaaagggaagattcaccatgtgtcctaactatatttactatggaagcatggaaaataaatattttatgtttagatttctgatctctctttcaaaagcagttggaaattatgctgagaaaatgtcttagcttatcccatgttactcaagaaaatgtatttattcgtttttgtccagtggcttaaccaaaccacagtttatttgttgctcacataaagtccagtgtcgatcaggctactcttttccatctttgagctaaggcacatattacacataactttcagtgtacccgaggtagaaaaagagagagcttgggaataaggcaggggctttttactgtctcaaccccaaagtgataaactacatttattctcaaaatccagataaaactcccatagagcctctgaaaacctcaacatttgcgtcttaactataataaggttaactaagattccaaaattattttaaaacagagacagtttccctcttccctggcagctaatattgtattttctataaatccacttgcccaaggtttaaactacattttatggattgaaatgacatttatagccaactcctgatttttagttagatggttggataatgatcttttgatgaaagactcggagatgtcatggtaaaacggtgaactactgaaactattgattattgttaatggcacatttcagctgattgaattgagtcaagaaactggtgttgaagagcaacaaatggaaatgccgagcttgaaaataaataaagcagcataccttaagagattacatgcaatttcagtatttcagctaaatggaagtgtttgctttttttcctctatgaatttttattttgaacaaaaggaattttctataatatgtaggtaggagaaaagtgaaatggcatgctttttcacttcatttgaagaagctggtagcattgtattcatagattcatgctgtatagcaatcatagttctcatatattaaaaaaaaaggaaatttgaaatgcctagccaaagcaacagctctgccaacagattttgatatatctgtctaccccaaaagtagtgatgatttacttcatacaaatgctagtgaatgaagagagagggtgaaaaccttcacaaaatgtgtttttctctaagactgtcaatccgtttttctatatatggagactccagctcttgctagactacctatcactttcgtctatcagccacttcgtaagatatttattctctcagcaataatcataattcatagattctttaaacatacatgtaatataaagcatatacattctgaatggaattaacatgattaattcttctctgaaagacattagaatttcctcccgtattataaaaaggtgtaactcactttccttactaaaatcaagaactttaccgtcgtccttgtacttcaggataagggggtgtttcttataaatattgttatttctgatatgctaactggaatttttaagcaaatgtatttttatagaacgccatacaaagcctttaggggtgaaagtttcaggatttttaaattgcagatttatcctttaaataaaaaaactatattcgtaattgaatcggattatttctctatccaaaacattttctgctttgggcctaagaagagttgacaaagctgttcatggttcaaagtactaccataaaaccctgggtaactaactgaaaatggaaagactctgtctttctgaatatttcacaagagtttcacaaatattaagtggttctctaagtacccctgagagatcattgtaatattagcttgtaaagacaatgtgggggtgtgggtatgtggtgacctttatgatgttcataaaggtggtgtaattaacatatttttctcagcaagacaaactaaggagcaataaatatatgagataccttcatctgtgatctgggtcatgtctcaggccatatctttcaaatcactcccttccctaatctcgtgttttacctacgtctcctctcaatccccccattataaaaattgtcttctgatgaataaaacatttccagagagacaagtttcataaagtttgaattgtacatctgagtacacctatgaattaagatatctttgatttctaatatgttattaaaattgggtgtggtggctcacgcctgtaatcccagcactttgggaggcagaggcgggcggatcacgaggtcaagagatcgagaccatcctggccacaaggtgaaacccccgtctctactaaaaatacaaaaattagccgggtgtggtggagtacgcctgtagtcccagctactcaggaggctgaggcaggagaattgcttgaacccaggaggtggaggttgcagtgagccgagatggcgccactgcactccagcctggtgaaagagcagactctgtctcaaaaaaataaattaaaataaaataaaataaaattggagaagtttctcaccaaaattttggcgcacggattaattctgaagaaagaagaaagaatgcaatcttagtagcacaattagtaccttgaataaattggagtatcgtatttcttggactatctgagaatgcagaggcaatttaaggatccctaattctaaggagaagaaacctttagtgtattccttcctgttgctttagtttgaattgagttttatatgtattttttaatctttctattttgattgttgtctaaagagtgtgaaagtgaattttgatatttttattttgcctggcgatgaatgccttctgctctggatatttaaaaattatatacacatatatgtgtgtgtgtgtgtgtgtgtgtgtgtgtatatatatatatatatatatatatatatataaaatttttctgagaacttttattaattcagcgtatctttgctaaacacctgccatgtgtcgtggtgttaggtctggtgatacaaacatgttcagagagatgattttctttcttttttggggggtgggtaagggaaagaaggcttatacaacagaatcttatttctcacagttctggaggctgggattccaagatcagggcctggtgagggcccctcttcctggtttgcagatggcttccttctctctgtgtcctaacatagcaaagagagacagagctctgatgacacttcctcttgttataagggaactaattccatcataagggccccaagaaaggtgcttttcaaaaacagttcagtaaaagtactgggttgtataatcactttaatgagtatcaatccatatttttaagatagaaatgaatgaaattagtaaaatagaatagaaataaggagtccatcacttttaagtaagtttcaatattgttcgtaaaactttggttcggtggtttgtgtgtgtgtgtatttgtgtgtgtgtgtgtgtgtgtctgtcggtgtggaaatactggatcactttgtaacatatattcaaaagcctctgtattttaacattatttctgcctttgagaggttcacattccagaggtgaagacatacatcctaagacaaaattataatagcattatgagaattacagtagagagctggacagggtctagcaaaaacagaagactaggctaaaccttccaaagaggccaggaaactcacctagaacggtggattttaaccttgcttatgcactgggggagattttaaaaatatctctgcccacaatagataccaactgaattgagcatagcatgtcctacccatgaatctattgtccagtgagaacctctgtttagagaaagtcaccttagaagaattgttaggagttatttaggttcatggggttgaaaagagcattcgtgatagaggaaacaccatatccaaaggcttagtcagtgtggtagtgtgagaatctgaaggaacttggctggggtatggttgctacaagaaatgaaattagatcaactggggctaaattatgtggaaagacagcatgatgtagcagctagagtatggaccttgtaagcaggaagaccccttatttagcacttactagcttattgtctgacctctgagtcccaattttactcttctatacaatgagtacatcacaggattttatcaggtttaaatgataagatatatgtaaaatgcataccagagaggcagactattggactcgaagggctcagtaagtgtaagctggctctctctgccccttgccacctatttttcagactctggacttttatcactttaagtcatagcctagttctaagcaaggaaatggactaatcagacatgtttttaaaagatcattctggtagtggttaggagaatgaattggaaagatatgagacccatgcagggacaacagttaggacattatttctgtaataagccaagcaagaattgatgatcaaagtggtgaggttgaacaaacaaaacagatacgtgagctatttggagataaaatcaacactgtcatatgttttgtgggaggtggaggtgagcagaaaatgtgaggtaaaatgagaaatcagtgcctgcttaccacttggcatgattgactgaaggtagtgtcttcactcaatcatgagttgcagaattcaagatggcaaacagttgtgaggagcaaagtcaagaacgtgtttgattttgaggtatctgtaagtgaaaaatcagaggtgaaaaccttacctctcttgaagcagttgtgaatgtaaatctaaggtttggaaaaagatctgggttaaagatttaaaattgaaggacatcaacatggaagccatagaaataaattatattacacacaaatttatgtcgttatttgaatttctccatggtccactcagaaatatatctaaatgtcaccaaaatgttacttactgtagtacagaattggtattaagtgatactattgtccatgttattcaaaaagacagttatagggaccctcttaataaactaattgtgaaaaaggcaaagaattagcaaagctttggcataaaattcatatcatgggccaggcgtggtggctcatgcatataatcccagcactttgggaggctgaggtgggcagatcacctgaggtcgggagttcgagaccagcctgaccaacatggcgaaaccccgtctctactaaaaatacaaaaattagccaggtgtggtggcacacgcctgtaatcccaactactcgggaggcagaggcaggagaatcgcttgaacgtaggaggcagaggatgcagtgagctgagatcgtgccattgcactccagcctgggtgacacagtgagactccatctcaaaaaaaaaaaaaaaaaattatgtcatggaaaaagtaaaagtctttgcataatgtatccaagatcatgaaaaactcttttcaataagataattagttccttttcttatataaacatggaaattttcatttttccttttattctcatattgatactataaaaaccccatcctcattcacaatactactgtctctaccctcgatagataccagttcaattgaacgtagcatgttctacccatgaatctattgttcagtgagaacctctgactataatgctcaggaatactcaagactcacatgattgtcttcttgctatatttagttactttattattttccattttgggaccctgaattcctgtagatctcagagaaaatccgaaatgaaataatgaaaataattaaaagtttagaaaagggagtcaatggggacaaatgttcaggactggtcttttatctcctgcaggaagaaagactgaatgcagaaaattagaatccatttttcatccagtcaccccaatttaatgcaatatgagtttagctatttgattttaagtgttgtaccgttttggaccatgttaccatggtaacatgaaccatgtctcattcatacgtaaacatgttaattgtattaaaacctttaaaacctacttctggatgttgccattacattaaacaattatctagaatgatacaaagtaatgactaaattgaataactttgtaaattaactattggattttgtaattttatatctataaaccaaaagaaaagcccacattggtaagaagacactgtgcatactgaaaagtcaattttgttagcctccaataaccattgtgttttattcctcgcagagcttttgtgaggatcttataagggaataaatatgaaagcactttgaaaaagctttcaagtgaaaggtccttattaattttatgaattaccattaaacaaaagtcaaactgaagatgtaaatctaataggatgctcttaaaagtcaatggatcaaagttatattaattaataaagaataataactaaatattttatgtttcataattggcaaagtatctttactgtcattttctaatttgatccttagtgaaaacctgtgatgttggtactcctattatttccattttcatttgagaagaataaaattggagaggttaagtaatttatctattgctacttgttaaaataactactaaattttattactcccagttaggagggcaattatataaactaaaagcttgtcacaataaatgtttacttttctgggattaaagtcatcatgtatttttcaattattaaggggggtaataataataatagctacctttttaaaatagttactatgtgccaaggtgtgtactaagtgctttgcttgcatgatgtaataccatcgtatatttagtacagaggaaaaactgagaggctgggtaacttctactaaggtaacacacaagtactggttgagtatcccttatccaaaacacttgggaccacaagtgttatggatatcaatttttttctgattctttttttggatttcagattttttcagattttggattacttgctttataattatgggttaagcatcccaaaccccaaaattcaaaattggaaatactccaatgagcatttactttgagaatcatgtcggcgctcaaaaattttcagcttttagagttttttggattttggattttcagatttgggatgctcaacccgaatatatagaaaagtcagcatttgaacctaagtttgactttctgatcttctaccaactctactgtcctacccattactctacattgactcagcattacagggaaagacccaagatcaccaaaagcaagcttcaaatcactcatctaatagaaattagtggaaatatttctacttcctaaacatccatctttcctttacattttaaagtcaagtttctacatctgcctcccaactgaaacacttctctatgaaatcaccataactaccaaatgcaaatatttttatcaagtcctcattgccctagaaatctactcatattttgttattactgctcactacagcctactgaaaaatgtctcaccttttgacttgccagggtgatatattatactaattgtctccttgtctctctaagcactcattccttcctctttctttcttctttttttttttttcacttttattttaagctctaggggcacatgtgcaggtttgttacatgggtaaattgcatgtcatgggagtttggtgaacagattattttgtcacccagataataagcatggtacctgataggtagtttctcagtcttcaccatcctcccaccctccaccctagagtagatcctggtttctgttgttcccttctttgtgttcatatgtactcagtgtttagctccacttataagtgagaatatatggtatttggttttctgttcctatgttatttcacctaggataatggcctccagctccatccatgttgctgcaaagaacataatctcattcttttttctggctgcacagtattccctggtgtatatgtaccacattttctatatctgatctaccattgatgggcatttaggttgattccatgtctttggtattgggaatagtgcagcaatgaacatacagctgcatgtgtctttatggtagaatgatttatattcctttgggtatatacccagtaatggcattgctgggttgaacggtagttcagttttgagttcttagaggtatttccaaactgctttccacagtggctgaactaatttacattcccaccaacagggtataagcattcccctttcttcacaacctcaccagcatctggtattttttgactttttttttttttttttttttttttttgagacgaagtctcgctcttgtcccccaggctggagtgcaatggcgcaatcttggctcactgcaacctccacctcccgggttcaagtgattctcctgcctcagcctcccaagtagctgggattagaggcgccttccaccatgcctggctaattttttatttttagtacagacagggtttcaccaggttggccaggctggtcgcaaactcctgacctcaggtgatgcgcccgccccggcctcccaaaacgctgagattacaggtgtgagccaccacaccaagcccacagtatcaattctatgcattcttttctgatttcattaatctcattatcttcatttgatatttagtcaatagttactgtcagttatgtgttagttattatactagaaacagtcttttctccatctcctttaatccaatgatttgaacatttttattcctttccaatgtctgtcccacatttcttactgtatgtaggacatttcttactcaaatgtctcacaaatgacataaattcagtatgacccaaataggccattttttataccaagtcttatttcctatcctgctgttcatcccggtaccatcttttcagtcagagagttcagatcatatagtcatttctaaatctcccacttacttgcctcactttcaagttcatttttaaggtctgtagattctgcctccctaattctttatgaccattcctttctcactagccccttacctccactctcattcacactcttactattttttaccctcctccactcattcctgcccaccagtggctccaatccaacttgcagatttccatttaaattaagcttcctaaaacatagcttaggttgtaactacaatgcaaattccatgagagcaaagatttcatctgctttattcacttgtatatatccattgtccaagactgtgtgtgtcacatgaaaagtgttcaataagtatttgtcagtgaacgaaaataatatatgactcccctcttcaaacaccttttttgacttcaaagcccttcagaatattctacagactccttcacctggctctccacaattgcccctgagtctcgtttccaatcttatttcttattttacctctcaatgcaccttcaactcctactaaaatgaacagctagccagcttacttctgtgtctttcgatgatcttgttttttgtcttgagattcctttttttcatctaagcttacccaaacattacctacttttcaaggaaagccattttcgaatcttccctttttccctgagcccccaagctggaagacatcttgtctccatctcaattcctataggcatttctctgcactttaaatgacgtttagtacttctgacattgcattagagagaggctggggtggatagtgtttcatagtgtgaactttgaagcccgactgcctgagtttaaatcgtgattctggggcttactgaccatagacgcatttctgaattgctctcagattatggagcataaatcaaaagtaatgacagctacctcttcaggttgttgtgagggtgatgcgaattaatgtactgaagtgcatggaacagtttctggcacacggtaagcacccaataaacatagctaatattatgttattactattttcaggcttatttttatgtatacatatagtatgtaattttatgtcaatatgtataaatagactttggtattgtttatttcactatcaccttgagagcacaattctcatttgatttgtgtgagaaactacttagaaagaaatagacgtgtgaatgaaactatgcttgaaatattggttactgtgagtgttgaaaatccattttgtttaaagaaagcttcaattgttaatcttccataaattttagttcttaagcgttcatattgactcgttttggaaaagctctttaaagtcttgggatataaacaaggctgaataccctcattcatgataacaaacatattatactgaaaattgtaagagagatattttatctttcataatgccctccttgggaaaatacattgacttggcccttctctttcaatcagacaccaaagttgagattgcctgaaacacagtttggtaaaaggagtttctttttcccaaacatcctgagtaacacaggaaatcacaccaatgactgatagataacgttaataaaattaataaagttgttttaaatgcataccatggggcagtggcaatgaaaacattgagaaggctgggactatttgccaactttctttgatctccattagaacctggacaagatccacataatttcagaacttcttctccaaacaagaattgaaaaggtcaggaaaagtttgaccacagaaaaatgtcaaagaattttgtgtcactttctcctcctcccttcctctaaccttgaataattttttagggttattggtctttgggagcagactttctagaccaaaacaaaaaaaatgatattcctctatgtgataggtaacaatcactacccatcctactggaaaattctcaaagtgtaaattgaggggataaaaaaagaatcttaagtcctttaaattatttttaagatgaactacattagtgcctctcttgtgcctttcataattctgataataaaacattccaggtattagtcaaagattaatggtattgaaaataatttaggttatcagcatgtgattttcattccacatgaggtccttttgcagtttacatggttttctaaattatattaaaataaaatgtcagaaagttcacatttttttcatgtttaacagcatcaatctttaaagaaaagttattgcacaaaggtctgtgcataaatcagccattctccgaagaggtaaaagaagtcattacgcctggttatgagagagagtttcatgaatgtaagagacataaatcatttcccactggagatcatattagtctagatggaagaatgtctgtttcttgatagtgagaaagcaacaaattacttttgtttgctcctgagtctgtggttgtccttgagaggtctgttagcatgttgactattgactattcaatattagcattataataacttacaatgatctgagtcacataaatataatctttcagttctctaaagattttactttttcctctctaatatctattcacctccaacacctttgcaaatatattattctctgggagttacaaagaaagttattctctgcaggaagcagcatttcagttgctctcaggagccaaccacatttcacctcaattctttgctcccaattcaacaattcaatattggattaaattcaaggctgtgaccccaaatagaatgagacctggatatttatgaaccacttgaccaggcattcttcccatgatttactccataaatcctttttagtttttgcagtagctttacaaatatttggaaaatggctgtgcaatgcagttttaaaaagtgcaatgagtagaggtagcttcttcacctggtatggtaaattgttgattctcttttggagtggaaaacaagtgttcttatttggatgcaaccattgcattgattagacaaccctaaattcatctttcatccatgacctgaaagaaattttgaaattcatgcaatatatacccgtagtggaaaatgtactttttgaatggattcctgaatgtgacttttaagaagagctattaagaagtgggatcttctacagaacagtaaacaggcatgaaaatatacaagttgataagatatggaactaccccaaaagaggaattaatagtggtggggcttggggcaggaggacagagagacctagccaaggaaggaagggctatattataatagagtacaaagtcctttagtcatccaagagaaggggcaccttctgcatcccttatgagtaagatcagagaaggtattctagttaacttttgctacataacaagccagcccaaaacttcatggcttcagtaaaaattacttgttttgttcatgaatctacagtttgctcaaggttcaatggggcttgcttatccctgtttcagttgatatcagttggggtagattgcctgatgctggaggattcacttccaagagggctcactcacatgcctggaaaataggtgctgactgtcagtttttcttcatgtggacctctccatggagcagtttgggctttttcacagtgtaagagttgggtcccaagagcaattatcctaagggacaagaaattaaagctgcaagcttctcaaggcctgccctaaaagcaagaatggttttgcttctcccatattctatttgtcaatcagtgacagagctctgattcaaggggatgagaacataaactccacctttccatggagaagtatcaaaaagttttgatgccatttaattaaagctgccatacaaagtttcttataaatgacactgagctgaatgaatactaaacagcaagtagtcattatcccagtcaagagaagttatctttgctcagaataccctttctctccttgtctacctggaaaattcaactcttggccaaagccctacctcttctcgaaagcattaccaggccttgcctctaagtgtacaattggagatacaccagtatactgatgtttttaaaactttaaacttttttctacaataaaacataaattaaataacttcccttctgacttaaaagctgcaaaatgctcatgacagtaactatataaattaaaattaaatcttaagcacgataaatacctctcgaatagcaacatagatgcttacttctttatttcacttctttatttgcttttctttgtctatagtttgccccaaaggtattttaataatatcgggttccatgtataccagtgtgtaccaattaatatttagaatatacctgttaataacctcatttgcatagccctactaatctgagcacagcgcagccttaagaaagtcttagtttttctcagtttagttcatctctcttctcttctcctcctgtctctcttatttcctatttctttttcttttcaagtgactttcaactaagtagaaaatgcatttcacatcactatgccggcctccaggctctgtctatttcattcacccaggaatgccctttctgaatgctttctctcatttagcagctatctattgaagttggacaaatgatagaaattcatttcttaaagagccagaacatcatcttgaacaagaagttaaaagaattcagcaaatcaaaagatgagctaatatgggtgaatcttagaggcattatgctaagtgaaataaaccagacacaaaatgaaaaatattgtatgattccactggtatgagctacctacaacagtcaaatttatacagacgtaaagttgaaggatgttaccaggagctggaggaagaagagaatgagggcttattgtttaatgagtacctgagtttcagtttgggatgatgaaaacattctagagatggatagtggtgatggttcaacgataataataatataatattaatgtacttaatagtactcaactgtatacttaaaaatggtcaagaaaatggtaccccgttatcctgatgtgattattacacattgtaggcctatatcaaaatatctcatgtaccccgtaaatatatgcacctactatgtacccataaaaaaaatttaaaggctaaatggccaggcattgtgggtcacttctgtaatcccagaactgtgggaggctaaagcaggaggatcacttgagctcaggagttcaagaccagcctgggcaacatggcaaggccccatctctacaaagaattcaaaaattaactgggtgtgggagctcatgcttgtagtcccagacacactggaggctgaggcaggaggattccttgaacccaggaactggaggaagcagtgaatgacactgtaccccagcatggtcaagatcccaaatcaaaaagaaatgattaaaatgatcaattttatgttgtgtatattttgccacaatacaaaaatggggaaaagcctattcgcttttaagtatccttaaaaaggcacagcttcttcagctaacagactctaaaactttttttaatagaagtattaaggtatttagagagtgcaaaatatcttattttaagtcaagaagttagggtcctgttcctaaacactagcctctgtaatcctggggaagtcagtgctgttggagatctcaggttgatcttctgaaaaatgatggatctaggtaaaagatatgtttctccaggtttacataccacggacaccatctttacttggaaactttattaaaaatgcattgtgtcagaagctctctggggatgggtcgtggaatctgcatatgtaaagagcccctaggtagttcttgtgcccacttaaatttgagaaccactagaccagatgttttgcttatggccctttcagctctgaaatttgaaaaaaaaaaaaatgattctgcaagacagagtctctgtgcttttgcaggataaagaaatgaagaaaataatacttcctgcttgtgttggagcatttttttcatttggtatccccatctccagtggctagccaatcaagaatagtattgtttattcttcccactgttttgaagatacaaaaggaaaagctaagccagatgacacctaaaggcttccattaccattttcatgtttttccctttgcataaaaactgtccatgcctccatcagagccatgatcactagtacaatgttacactctaatgactcatgacattaaattatatcttagcctaatatgaccaaattacaatatcagaataaaaatttcttttttcaggttgaatcccataacttaatccaattataatactggctgaatttttcacaattatgtctcagtcttgatttagggaatcttctctttatcataaaaatgcattttgttaaacatgtttcattataatcaatttctcaaaagtaaagttaatcaagagaaggaaaaaaggttttgttttgatttgatttggaatgtgtatgtgtgtttactgtattgaaatagattctgtctgaaagactgtatataagataaaaagtacagaagagtagtcagagagttattacccacccctgactgatggtgaatagattatctaagtatcccgtaaaaggcacaactccttcaggtatattttacaaattaattagtaactttctagccaaatttgtgtcttaaagacaccagctagaacttggttagttctagcaaagaagattattttattctgaaacaggtttttgttgtcgttttacttatttgaacttttttcttgaatatgtatttctttgcacataaaatatattgacttatgaatgtgattaaaatggaaaataattagttgattttagagagacagagagaggagaagagaagtgtgaaggagagagggaggatagaaaggagagagggagaacaggaaggacagagggagaatgggaaggagagggagagagagagacagagagagaggaatggagtgggtaataagcaagagaaaaatgccaatcatatgctttgctagtgtgtaaagtctgataacccaagggagagaggactactctggcctagtgaaacaaaggaaagagaaatatggtagaatattctcctggtgcttcaccaaatgtgacaccagaagtctgacagaagtcatgtcagcatttgagctccataaaactcaggctatcgacctaccatgtgagagtctcaaaatgagtttaggtaggggcagaggagttgaaatccagtaacatatgcaacagtgatcacaccaggattgcacatagaaagcaaattagtcctctaatagagacgccaatttgaaattcaccctctgagcaggtttttaagcacactcttcttttacttttctatttacaaaaatggaacaccaccagaaaaacaagaatttgaaagacgagatgagaaaagtaagttgtaattggaaacagacagaatgtgtacacaaacacacacacacacgcacacacacgtgcatgcacaggtgatgagagagtagtttgcctacatggtgtatctgactaagaagactttttgctctggttgtcttacaggaagtgactaaatctcatgatgtgaaatattttcttgcatattgtattggaaaagaaaataattttcccaaactccttaggggcagtgttgtcttataattcccatatagtatatgctcttcaagtaagtaactccagagttgagtaagacaagactcgtgactcagatggcatgctctgctccctagactagacattgcatcagtctgcctatactcacatccgctgttaaaggattgcctccagtaaaatatgtcttttaattccttatacaagaatctggaaaaaaaaagtaagattctctatttcttaaatttagcagcaggttaatcactgataacaataaaaatacataacaatcatctagcacgggtaaatattgtggcaaaaattacaccctgaagaattcagtcaaagatataagtaagtacacatcattgtcatgttccacaatatatcatctgctttaaagaaactgttatgtagctgtagtagatttaatcattaatcccatttcttctccaccttctgcaatcacaaccttaacaatgcctccttatgagtggaatgtacttcccaacccctagtcttaggggttggccatgtgatttgctttagcaaatggtaaatgagcaggagtgagaggtgacagttttcagcctaggccttaagagatctatacattcctgtttgtgcttctgctatcattctgagaacacgtccatctaggctgctggtctcaggaaaacgataaaagacatgaacagcagggctgcactagccattcacatccaggaaaagaaatgattgttgcataaagccattgagctttattctacattactgtgacaatagctaattgaaatagtaaatatactttggtttttcctaaatgcatattgaaaattaataatattagccatctgtatgataaaaatataaagcctatgttttattttttaatggttcactgccctaaataaatttccaaaaagtagatgttcccttgtctagtgatgtcattatattttatttatacatcataaacacactgtttatttctgctcatttttttgtaagtaacatgtgttaccgccaatcttgagatgatacacacacttctgtactaaattttggaaaacatattagctacccactccttatatcaaaatattgcctaataatgtgttttgttttaatccttcatgaatttccaggagaactgaactgatacttgggtttgtgagatatatgaaaatagtgaacatgaacttctggtttaacccttgtgatgataatggaatcatagctctgttaattactcttgtggtttgtcttcctagagataatcatgtacaaaattcctttccaatttgttatataatattagaaatacttccaaaattggcatggatttattgttatcatttgttggcacaatcattaaaacgaaacccataaagctagataattaaatgtttacaaagctatagtactcaaaacaaaaacactgtgaaaagagattttttaaataatagtttttgcatgccttttgaataattggattattctgaatttcttcatgtttagtccctgaatctaagtcataccgtctacataaaaatagatgtcagctgaagaaaaccaggcaatggatttgtcttgacgacaatctttttatatgttcagacttcatttaacattagacttgtctgtatttgaaattggtatttctttacatttctgaatttagggaaatggcacaagagaataacattaatttcctctgcattttggcctaatcaaatttgagcctttcaagagacacagccaagtcaattcaaagagacatatgaaaagactactgttaatgtatctttaaaatgaattagcggcatgaactgttgctaggtgagttaggtatagttgtagtttttagtaaccctaagagaagatgcagtgcattctaaaatgtcacaaggagtttgattgctcaaaattctgggagattggctctctgcaaggcttcttgatgtcattgttcctagaggaatgttgttccagtacctatagcgattgcagccataactatttatgtgtcattgtagccattgttattactacatgcttcacatacctctactgaggtctaaagaattagtggacttcatattctggagagaacacttgaagaaccaaacagaagtttgatgtgaatctgcatatccaccattattgttcataggttctcaggattagttgagtgatgccttaaagaaagaaagtcagatgataggtcttcctgctgcccgcaccacatcatgagtgttattcctatagaggaggagtaaagagtgggaagaaaatgaaatctgtcaatactgtgaatatataaataataaaagtagcagtaggactgattaattctgaatcatctttatgaaatgactggagccgtgaaaatgctcagtctgcacagctgattgagaaatgtatgcaatctgttgatcggaatttatttgtgaatgctctcttccagagatttatataccagagttcttaaaacgaattttgtccccatgaaaagaaaactacagatctgtaagactgcaatttaaaatggaagaaaacatgttcccacttgaagaacaactttcaaacaaacaactgatacaaaaaagtcaaaagctgttttgttttatataatagtttcagaatacttccagtcaatatataccttggtttggtgaaaaaataaaaagctaaatccttagatcattaactagaaatttttgtaaaataaataaaagccgtgggttttagtgcagtgatcccatgaagaggaatatattcaccattggtctcttaatctcagatagaatgtacatgttactttattttataacgaaagcaactgtgttgtgatattatgtataatattataacaggagaagtcctcttagctaactcagtaatcaataacattgtacgttgtgtgttattgtaaccaaaaactatgacagaaccccatttcataagatcagtttatccacctatatgatttatatttgaatattcatttcagtacttatgttgcttaaacaaagctactgtattagtccattttcatactgctataaagaactgcccgagactgggtaatttctaaaggaaagaggtttaattgactcacagttccacatggctgggtaggcctcaggaaacttacaatcatggcagaaggtgaaggggaagcaagcatcttcttcacaaggccgcaggaaggagaagcgcccagcgaagtaggaagagccccttataaaaccatcagatcccgctatcatgagaacagcatgggagaaactgcccttatgattccattacctccacctggtctctcccttgacacgtggggattatggaggttatggggattacaatttaagatgagattgtggggtggggacacagccaagccataccaaaaactctgttttttgtttttgtttaatggaaatgatttagaactttattttctgatgtttctttttcataaaaccacgacaccaaaatctacttttcactgctccattcaactagtagagaatatctaatctcttctcaagtatttctttctcaattatggtggttttagctaagaacagcttatggcatgcttttctaaataatattagaacacataaattatctgtacctggtattaccacattcattgctcattttaagatctcaattgatacattcaattcatatatatttaaaattgattcatttagagcaagagatacaggcattttaatgtattacactgctactaaagcttagcaaattattcttttttgtgcccacaaattatcatccattcatgtcctaaaaataaaattgaatttattatactttcccatttatccaaaaaaaaggttttttttaacaattgatgcagatacacattttcaagctaaaaatatgtgtgaaagtggcctctttctcatagtatttattttaggagtctagcaataatttttcttaggttatcagcacatgtcttagcctgaattatttgaattcagtctgtgtcttcaagttcagatggttatgtgatcttgttaagatctcaaagtagtgggaatgatggagtatacaacaacctcattgttttttatggcaactgtcatttactgaaggacataaggctagcagaacatggtcagagaaggaatcaaagtttggtcagccaactctgctccacagctacaagctgctagacaggcataaatttttccaaacctacacaaagggacttagggcccttggctgagagcgacattctaaccacttccttatttatggctggtggggtttgtacattttctcatttctgtataacatttcttgactgtaataagcaatgtattcattctgctttaccactttcactaaccttaacctcaatatatactcaattaagcaattgaaaacagcagttttaatcttttgacataaatgatttcctccgaagcaaaatgctggaaatcccctcaaatgcaccttttattgatgaatacctataagcaccacctacagtcgctggaggctgacaggaaccaaacttgatgataaccactgagctgagaattttcaactcactctttttccctgtatggttcttctagctgcattatttcccactatttaaagctacagctggtgaactattcaaatatttaaactttggagaagaaaatatcaacttatcacaaccctctttttatattctaaattcatatacctgtttggtacttaaaggaaaaatatgctgaggaacaggctggtcataagactgtatagaacgtgcatcttccatcctattgaggtgactcctagacaatgggaaaaatgccttcactcgacttgctcattaaatgtgaccgtagctgctaatcttttggcgctgtctcgaactttaattagatgtgctcttctcttgaaggttggaactacagtatccagagaccatagaatcacagagttgaaaacaaaatcttggaaatcattgaatccacttatcagatgagaaaaaaaaaataagcccatggagatagccattttaaaacatatcattctatttagcctccaatgtaaaacaatgagttactatgtttcaataatgttgatgttaagaaattatttgatagcttcctcacttggtctcctatattcctccaaggttactagttaggaagactgtcattcaaatttggagactacataagaagcagaaaaagcatataaagaggcacatgaaattggaacttttctggtaaaatcttctttcttaaactctcctcaaataagctgttggtggcaggaggtgaaagacagcctccaccctttagcacagtccgtacttgtcagcatttcccaggaagggtgatgtctggaaatgatagagattgtggaagcacattgcattatgggtcaagaatgcgaaggtcaaggagtggagtcttcctttacgaagtagtgttaactgcttggcgtggcattgttgtaaacagaagccaccaggaaggatcatccttaggagggaacctgtagatatgactgaaaacaagagagatccagttttaccactctggaaacataggtaatagaaagcccaaaaggtaccttatcacttgtttgttcctttctgtacaaaaggacttaaatcctttctgagcaagaaagatatttgagaatccaattttgttttaaacttgagcttagcattttggaactattccaaagaccacagaattcacagtcattagcataccacagcagactcttttcaaatattgcaaaccagaacagtctgcttgaaaacctggaaatacgacctagtgggttcaacttgactttttttatttctaacccttacccctaggcaattattgataactcattctggtacctggtatgtatatggactttgttagaagaatttgacaactttctaatcatctgttttttttcttttgcttgatagacatacatttagtagaactttactggattgtattgattataaaccacatttcagttcatatcagtccattttgctgcacaataaacaaccaaaaaaatttaattcagtggctaataacaacaatattgatttattcatggagctgcagtttggtagggtttggccaatcatggctggaaatggtttagctatgcttatctctaggccgtcggttctgttcgggtctataccacatattttcttctgagactcaagctgaagggacatcagctactcggggtatgacagagtagcacaaggcaatgacagaagcacaaacaacacttttcaaaatctctcctcttgtcacatttgtttatagcccattagacaaaacatgtcttgtggccaagcccaaagtcaaggggtaggaaaatactttccacctatgtgaggccatggctggagcgtgaatgtatgatactactagggatgtgaaaggattgaggccaataattcaatcttctattggagacaagctcaacgagttagttaaaatggaaggctaatatttactaactttgcaacccaaggaagagaaagcaggatctctctgacgatgacggaatttcataccctcatctttgaagttatactaaagcttaggaacaaccgtcagataggactgaattgctcccccttccagattcagcatgtgaagtatgcagcatcttattatagcagtagccaaaacagccgttttcttcaatttgggaatacaatgtaggtgtgttaattttcaattaagagttctaaacttattatctgcttggtagctcttccatgtgacagtcattccatctgactcttcatgttggcttttgaactaaattttaaaggaaccgccaaaatttaagggccatgtactttttataacctgtttgtggtctgggtaagaaaataaaaattatacaactgttctttttgaccagccacaagcatgtaatgaaaatgactgttttggctagcagatgtattagaagctttcaaggtgtttaaaaaaaaaaaaaaaaactggagaaaggagccagtgaattgacctcaaacaaaacaagaacaaataaacaaaacacttgtctgcacttccaaggaagggtgatatctagaaaagatagagatgatggaagcaccttgcattatgggtcacaaacgtgaaggtcaaggggtggcgtcttcctttatgaagtagtattaactgcttggcagggcattgttgtaaaaagaatccaccagaagtgaaacaagcagcactaaaagttaaaagatttatgtgtaaacctcatctaaggcaacagaagccatttctataaaatagtataggaccttttattatatatggtcctagagtatattaaaataagtctgtttgggtccatttgcagctcatttgaagatttttataggaaaaacatcctcaaaaatatcatactacagtgccttgatgcttttttctttttataaggtactgccagcccaaatagtaagaaaccgatatgatttttgtccatgtgaggtgtttaattgcttcccaaaatatggttattgtgtagatgtcactaacgaaatatataaagagcagtatttgggaaaatttattttaataccacctttttccttttttaccctaaaagtatttatttttttcgtagcatacactctgtgtctcagtatcattgtttttcataaaaacataaattcttaacagaaaatttcctgcaagctcccctaagcttgaagagacaaaggagatttgtaatgtagctcagccccaatcagggtaaaagaatgcagggctgactttatacttataactcagaaaaaggttatgcttcccgtctcttcacagagctagtctcttaattgattccgaactaggaacatgtacaagtggcccacgatctggaacagactggcggataatggaatattgagaccttgtctatggtcagccatattaacactggataagtctgataacactgtgattacatatgtatcaatatagtatgctgttaatatattaaaaacttatttacaacatgattattggacaactgttacagtacagccacatcaatcctatatcaagttagaccatgtcaactggttttgtgttgagacacctgtgtatggacatagtctgaacttttcatagtttgtgctaaatgatagcaatcaacatcggtatggcacttacagtttactgataactttcatgcccattaacatagtaccgcaataactctgtgaagtgctgaatttgtgtcctgtttcatgattgtatttgtgttgatatctcagtcagtcagagtcccaacaagaaacagatggcacattcagattagggtaagttgaggagtctttatttacaaggcactacatactcaggattgggcagggtgtagggaaatctcacaagatagcacaagactctaggactagcagcagcagagctgtcacctctcctagacctgaagccgttgttggggagagaggtttctcagagcccagaaaaaaagaaaaaaaaaaaaaacatcatgcagattttaatgccttgggaggagcagtggctttctcttaaggacagaatttgcctcgaaatgatactcagggaaaaagagatgaagggaatcaatactctgacccaagactctcccttctctgcagtggtttgctagtcctctccttggtcaaacccaaacagaaaaccatagggcataggagtctaatgatgtaatccaagtcagccccctggaaggtggaaaaagaagggaaaatggatctggatctggagggataccaaaaaaaaaaaaaaaaaaaaaaaaccatagttggcatgcttgtttattgatattttcttgcatgatataagaatccagataaatatagtaagaggtctattttactaacaattttaggcacctaataataatactccttctttgaatgtataacctctagaattggttcagaaatgtaactgtgccgttacaatttctattagtattcaacagtagattcatatccattcatctatgactggagtatctgccatttgctggttagttactgtgtaaggtactttgtaaggtatagaaatacacttggggtgcgatggctcatgcctgtaatcccaaggatttgggaagctgaggcaggcagatcacttgagtccaggagtttgagatcagcctgggcaacatggtgaaaccccatctctacaaaaaatgcaaaaagagtacctgcgcatggtggcatgtgcctgtagtcccagctactcgggagcctgaggtagaaggatcacgtgaacccaggaagtcgaggctgcagtgagccataatggcacaactgcactccagcctggatgacagagtgagaccctatcaaaaaaaaataagaaataaatttgagctcagtgacctacattctagtgcagaaaaaaatgaccatagttgattatgagattttaaagcaataaaccacatgagacatactaatgagctcataagatcattcagaaattgtttattatgaacacatagtactttcagtgtggcattaaacagagatcactgtccttaaacaagttaaaagcagaatcaaatcatctgcaaattaacacaccactaaactttaagcttcttgagtgattctgtaatttttaaaatgtcttcagcatttcagtgtcaagatagtgcaaactcagtaaaagcttgtggaattgcattaaacaaaaccaaaataaatagattttattaaaactatatacaattgtctttctaatcatatcctctccatgaatagggaagaaataattttaggaatttaaatatcttctatcttaatagttcctcttatttccctcttaagcaatgttcactccttcaaaaatatttattgagcatctaatatgtacttaacactgtgccaggtgctgtgaagaatgccaaggaaatagaatgaacttctaattctttggagttccaattaaataacctaaagttaaattggtttcggagagaacattatgccttcgagactgtaggcttctcttgattagaaagtcttaaacattttaagtaactaaacagattaaggagaattcaaggatgcctctcactagtaaatttggattagtctggcaaacttcagaccttaaatgcaagatttttaataattaaaagaagagagaaaatgataattacatttctagagtctatgtttaccattcagccttcttaatcatttcctaagtatatctggtgatcaggattttataactccagaaaatctttctatacatcgcataaatctcttcttttaaaaagctcttcaattttgtattttgttaaaacttaaaagcctccatgaaaaatgagacaaaagtcagtgagaggctgtagcaataaaaatcagatgtgattttcttttgaataacatctgtttttacagtcctttcatgttaaactttataagaatttattataaacagctttattgacagttcaatcctatttctaaaaggatttattttcccccaatggtaagagttttcttttcttaaacctaactagttgcagatatttcagatactacatttctcattgtgtaaggtaaagtttctgaccacctgaatatgacttgtagctcctgagaacaatttgtttagtaccgatatcatgcagtgacattggtacaaaggaattttctttatttcactgtactgttttcagttttattctatagttgttaaataagaccattaaatatttttattagtcttatttcctgtttaactaggtgggtttttgatctctgttcagtaaagcattgtgctcttcagagcaagcaattgaaaagcaaatagtgagtatttctactgtaaaagtttaacattaaaagatatacacacagccaggcaaggtggctcacgactgtaatcccagcaatttgggaggctaaggcaggagaatcgcttgagcccaggagttcgagaccagtctgggaaccatagcaagactccgtctctaccaaaaaaattttttaaaaaatagttggatgtggtggaacacctctgtaatcccagctactcaggacgctgaggcaggaggattgcttgagcctgggaggtcaaggctgcaaggctgcagggagctgtgactatgctactgtactccagtctaggtgacagaatgagaccctctctctctcaattaaaaaaaaaaaaacaagatacacacacatatatttgcgtaggtaactctaatttcatttcaagtatgttatgtaacaaccatttgtgtagtgcttgtaacagtcaatatgtaaatactgactcatcttctttgacaattctacctagatacttattagagtcccccttagtcattgaaaggaaggttaaaatcaaaagacgttgtttgccaaagtaatgaaagaaaacttataaacacaatgtatcatgtctggggctgaactaaaacccttctgatatgtggtattaacagatcatctttcatgacagtaccagttattagaaataaaatgattggagttattattaatactaacaatagtggtattcttaaaatgacttccttatttatcttcacctttatacattctactactgcttcaagacccatcttgaattcttcttccacagaacattctgcattaatttcagccaacattgatttctctttttaaaatttgtcttgcacagtgaattagaaaaccaggaattggaaaaccagaaaagcttattaagtaagaagcagagaggagagagtttcaacaaagggccattctaaagtggtctactgcggacaccatactgattatagttggtgattaaatcttatctttccaactgattataaactcctccagggcatactcttatattccacaagatgcttatctgggtgcagagcatgcatgcagttggtatttgctgatttatcaactaactaaatcttaacatattattattaacaatttaaaataaagttaaatgtatcactctccacccctcaaagccatttctgttctttgttttcatagcaccattattatttcctgcatagtattttttaaaaaccgtatttttaaaatttatatatttgtttatttgggtatacttcactagattgtaagcgtcacaaaagcagaactattataaccccagccactaacacaatgcctaacaaatagtaggttctcaatatttgttgaatgaatgacctacagatattacttcattatgaaagattttgctaagttgttttacatctattttatccaaaactaaagttcttgaggcaaagcctagaatatcttctatgttctcacaatgctctgaatcagtgcttctcttaatatgcatagcaattgcctggagagcttgttaaaacatagattacttagccccaaccccagagatgctgattcagtaggtcccaggtgatgctgctgctgtcagtctctggcgcacactttgagtagtagggctctaggatgttatatgtacagacacatgctgaatagtgggctatgtgcttacttgctggctaaataataaatgttctcactgagtcatagaactttgaaatttgcaaggacttttgctattatctagtctatggatagcaaataacctgataccgtgctatagtgcttgactgcatttaacctgcagaatcctcatgagcagcccagcaccatcactccaagtgaaactactctcttcttgaggttgtccaattctatcaattaaagatgaaaaccaggttctgagagttgaaatctctggacttcaaaggtccaacagcccaggtcttctcaattctcgttagtgtttcagcagctgaatacaaatttattaagctgtatcagagtagtatctgtcaaattggagtgtccataatatgcttaaacagagaactccattccaataacatgaactttccttatgctttattcatcatcgcttgaaattttgaattttgcccaaagaagtttataccagtacatgttaaattacatcatagccttctttgtataaatcttagagtagtttactgaagtacatcgcaaagttttgttgtttcttaggtgattttaattatgtatgtttactttcagtaatgcatcttttctccttcatcaatattatgttatgctagctgtaagtacaaaataattgagaacaaattatgacaaattgaaccaagccacaaaaaaaggagaaaccaaatacttttgtgatttgagcttttttcagtccttgaaactttaagaatatctgtctttattaacttttgctttttgctgatggtttctctcattttattatagcttatagcattgtaaattaatttaacatgaaaggataaaaacgttgcttttgaaatgtttctcattaaattatgaaaaaatattacactaaataaaagaaaggaatgcctctggtaccagcttctgtttgctcaattattgcagtacccaaagtgaattattacacagttaactcagaggcaatattattgtcattatattataaaatagatgagttgcaatcttcaaaaaaaaaaaacagcataggtcctttgaaagtgaaataccttttttccttgtgcttcatttaaatatatactgaccccagttttgtttttgtttttcctttttagagttcttgctaatgatgggcccaaagttatattaagaactgcaaagtaaatttcaaccaattactttattcaggggagtcattaaattgaggtacctctgaaattttggaaggaatgtactgccaattagccgaaagcactactcaatgtcctttctatggttataatctctctagtgtatttttaattgaagacaacctctatagaggaggtgagaagttgctatttattggtacttgttaggatggaatcaagggtgtggaagatattcatctatttctctctccagctcccccacacaaaaagaatggtgcttaatccatctgaagcatttggggagcgagggtaaagatgtaatatttaccatgagccgaaacagatcttcagaagtggaaaatggaagcatattgaagtccctcaactaaacagactttcttccatatggaattcaatgcattaatgttttcaaattctatagcttcaaattcttaatattttcaaattatgtgagcttatgtcaaaacatttaagtgagcttttaacaatgaggcaaatatttgaatcatttgtctacataacaaatactactataaagcatattaaatgttataaaaatcctaatatactaatgtaagctattataaagtacaaataattaaacaatatttatatgatcaatgttttataatacgataaacacattaaataattaaaaactcttccaccgtgcaaaaatgactaaataaattgttaatttctaaggctttttgagattactgtgaaagggggtatagtttcaggaaaggtgaaacttcccttcaatgtgtaaaccattaaagaacataataacctactgagtgtgggtctcaatgatatgccctggaaagtatgggcaactactccacacccaattttgtctttatatgataaggcacagcaaataattataatgcaatggataaatggtaaatcccaccaaagattaaccaatcagagcaggatgaaaattctgagtttggaaatctattggaagatttacagattagattaaagtgcccagtaaccaaactatcaaaattatatggcttcagttaattaatgatttccaaggtttttagtatactgtattacaaaacacattaagcatcttaagcattcaaacaacatttttttgatgattcagaaagcatcacaaattgttatatcagctgataataacttaggtacatatcaattaaacttgtattatagacacgcagaattcttcagaccagaagtcgaaagggcttctctagtttgtttatgctaagttgtttagagatgacataactctgagctaatttgtctattgcaatggttctcaaaatggggggcgggggatatttttacctccaccaagtggacatttagcaatatctggaggcatttttaattattattactggattggagatacaactgaagtctagtgggtagaggccagatatggtataaaatatcctacaatgcataggatagccctccacaaggaattatttaggccaaaatgtcagtagtataaaaattgagaaatgctagtctaatatagtgtttactcacctttcctgaaactatgtcccctttcacagtaatctcaaaaagctttagaaattaaaaaatcgtttagtcatttttgcatggtggaagagcttttaattatttagtgtgttttatcttatgaaatgttgataatataaatattgtttaattatttgaactttataagagcttatattagtatattaattaggattttatttaacatttaatatgctttacaataatattcattatatagacaaacgttttatttttttcactttaacaatgatttttaactctaattacataagaaaaagtatgagttaacaattttttaaattacatgcttggtttgagggccaaatacacatgaaaatgtggactaaaatttaaaatcaaataaaatctataaagtcgaggaaaaagctacttttatgacgaggcatggggaattcttcatagtttttgggttttatcagaagttagctattttttttctttttgctctgtaaacaatcagataagagaggctcaaatgacattttcaagtacatcttaacaaaatacactttgagcatcaattgagtaaagtttcattcttttgaaactttggttttcacaagatttcctgagagttttattttattggtgttctgtgggacttgggcatcataattcttacaaactactcagctcaatctaatgtgcagcgaagctctgggaacttttgttttgtctagtatccagttggaagattctatagctacagagcttgggtttaaaccccctccaagtctttaccagctacctttatgaccctggcaaattacttaaactgtgtgccaccattttctcctctgtaatacggaggcaataaaaatttccacttttagattttctatatgcggtttacaaattgacttactctgaagatcatctggagtaaaatctggagaaatatgatcccttataacttcttcaaccctttatatatttcaacatgagtaaccaatgctctaaatatggatataaattataagaataaaaaatctaggactattataatggtctaaactctcttcatagctaaaagtgttgagtaattaaaccagttgagcagctaaatcatgtacacacttctttgatccctcccacgatcatgtatttggcattgtaatgaaaagatatgtttattttcgagaatagacataactacctttaataatatgatcacccagaaatttttacaaacccctggaaaatttcatgaatatcaggctgtgctcataaaaccttagagatgagatcacaatagactgggtcaacatatagtaatgagcaggattaataaaacctcagatgggcatttacaaatgagtcaaaaccatgagtataattaaataattgtagcaaaaaaagagccttgggtaatcctttcagcaaacgtaatcgaagtgattgcatttagaagacaaatatttaatttggtgactagaaggtcttttattattccattatgtctttgtgtgtgtgtgtgtgtgagacacttttcaaggtcaatttttacttataaattgtctctaattaaaaattgacttggttattaaatcattgaaaattggccatcatcaaattcctcattaaaatatttctatgtgccatatatatatatatatatatatagaatatatatgtagaatatatgtatacatttatttttactttttttttactgtgcctactagagaaatttaaactacatatatgtagaatatatgtatgttttaactagacatactgttaagtacactatacctaatatttggcaatattaataccatctcattgagaaacctggaatatatgcacattttggatgtctattatatgttgggcactggactagtcattgataatacagagattagtaagactcaggttgacttcagccatgttgtcaggaagcacacactctagtttgggacagcgaggagaaattcaataagagaaatatatataaggcataatgctctaggagaatatgcagtggataactgcccaataggaccaggcaaggctttttagaggaggaggtggcatttgagtcaagtgttaaaggctgaatggaaattcactggttgagataaactccttaggaggaactactttaatagaacttgccgttagtcctgaaataaatggtgtgcaaaatcattaccatctgtcaattcactcagtctactttgctcttaacttcagaaaaaaatcagaaatacaattaaaacatttgagcctattttactgtcttttaaaatgagttaattcaaagaggaaattaaatataatgagagagaatctcccccgaggattgggggctggggaaatgctattgattctttgcttgtgtttattttctctcaaaaatacattatgcataaacttgatgatcaaaaattcagattattacatttctaaattggcaatgcaatttattgcatcatacatcaatcacaaaaatgctcatcttgctgactttcataaacttctaaatgaacaaaaatgcaaaaatagtttatactatattacactatagtagatttgttaaactaaaccagaacaatggtccatgaaaaataggcctctgactccaaacgctcacaccacaggatctctctgagatttttgtgtcatttcaagtcagagaaaattgtctaataaattgttggcttgtaacaatgaaaactaagatatctgtggggctattcttgttctcttcattttactacagcagctctgcccagtagaaataaaatgtgagccacatatgtaatttaaatttctctagtaggcacactgaaaaaataaaaataaagaagtgaaattaatttcaacagtatgttgtatataacccaatatacccaaaacattgtcattttaacatgtaattgttacaaaagttattaattagattttttccgttaagtatttaaaatctggtaagttttactcttacagcgcaactcagttcagatcagccacatttcaagtgctcagtagccatatgtgtctagtggttaccatattagaaagtagtttgagagatccacattaaaccaaaaggaaaagaacttccggcccttcactgatgagtcactcttcactgctaaccttggaagcattcccaaatgtagtctacagagtttaaatagtctatcttaacatctctcagggcttcagtcttaatgccatagtatttttaaagaatggtggatattcttttttacagaacactctgtaagagcaattagaagtttatgatgcacgtaatgcaaaatacaggtcatttcccaagcctattttaaaagcgcaaaaactgtagtcatttatcacccctgagaatgttgtcttaaatgtcttggtttggatattggtgatgtgagaactttgtgataagaaagtagtctttaagaataagatatcagactaaaattcatatctagaatgaaagtcttgtttttaatggaagattaagagcaagtctgattcagatcatgcatggggtacactagtctaggaaaacactagtctgaaaatatactaaaagttacttcgcaacttaacaagaaaatgtcttgtgggtgatgtcgttcttgatttttaggcaaacctacctacctttgcaaagcagctgggacctttttgcattggaagaatcatttggagcacaaacaaaattagattatcaacactttggaaaacaactacgaatgagcaatcagaaacctgaccttaagattacttgtgaattgtgaatcagcaaaataaactcgattgttcattgctaagtgtatttcaattatcaagggccttctagattataagtagtcttttttttttacttagtttacaattaagatgtgtggtatttgaaatacatttgccacagggagaaatataaattataattaatttcctaggctaattcaatttatgacatacctatatacattatctgtcatctataatttttcccttattgtttacttcccactggaagaatgaaaatggaatattattacatggcacatggcttgatacttttacaaactctgacaattatgtatttattttgggaggcattgagtttatttgttttatttatataaatttatgaggtacaagtataattttgttacatgcatagattgtgtaatggtcacgtcaggccttttagggtatccatcaccttaataagatgcattgtacccattaagtaatttctcactctcataaaattctaattatgtgaatttaatttaatctatttaatgtgttttaggcaaatatagccggtactataaacagttgattttaagatatcattgcttacattgagactaagtaaaacaaaatgggtcaataaatgtcaatctagataacaatgtcaactaaataagaggtcaaacatggcagtatttttgaaggtgatctgtgaaagtgattatagcgtttacactcatggaaaatgccttcagagtttcaactaagaatgccaacagctcattcctttatcctgatgcatattgtcttccttctcacccccagttccttcttcccctaacccctacccgctttcctttgctgattttgacagaaataggacccccaataagtcagggagatagcaggaaatgggataggatagaacccggaatgatagaatagctgagcctgaaggcatgaagaaaggctcctcctgacatctaaatggagacctaagagatgggttggtcaggtagggggaaggaaacatgaggagtattctctaagccaggcaacatactgtgcacaagtctgaagtcatgggaaagtgattttgagaggattgctgcttggtaaacctagagtttgaattgggagagatgaagctagaaagttagtaagggtcagattttttttttttttacttgcatgacaatggtaaaaaccactaaaggttctgtgttaagcagaggagtgacttcatttaaaaaggtaaattggattgaaatgaagggcataaactgaggcaaaaatatccttcgttaagttattgaagcccagttgaacacactggtggcttaaactggagtattggtataagtgggggaaagaggttaatagattccaagttgaaaaaaaaaaaaaaaaacatagactttgctatctagtaatggattaatatacaaaaggaaaaagtaaagtttctactttttggacagctagaaaccttcaccgaagtagggaacccaagacttagattatgttgggaggggcagggtattttagttgcacagggatttgctttacagaaatgactgaatgacaatatagagagatcaattccattaaaagaagtttgattactcacagttctcaagggaagagtacatactacgccatgcaaagccatgcaggaaaaaagttccagagtcggtcagcaggcagaaaaggaaagcacagcccaaaccctttattgtggtttccaaggaaaagaaatgagtgaggtagaataggcaagtctgagcaagtttaggactggatagttcaaataatttccaaaatttcctggctgtaaaagtggtctctggttgtctggtaccaagccctagggtgaggggaaaaagttagggtgggggaaatattggtttggtgtaacaacagttagatgaagaaggtagttggggatacggactttggattagttggtttgtataacgaaaagcaatccaacaaatccacaagggagcaagtttacaagttatttgctatctttaggaattagctagccctgggaggggcagtctctccctggccttccaaggacctcaagatgttcaagcatccataaaatatggaaattttttaaaaacattataaatacacagagtaaacgctgggcatgatataggacagtggttctcaaactttagctccactggaatctcctggaaaacttgttaatatgcagatgaccgttttacccttaagcttctaattggggaggtctggggagggcacagataatttgcatttctacaaagttcttccatgattttgatgccgctggtgagggaccaggctttgagaacactgatttaggacgtgtcctgtttagggaatatccaaaaggcggacaagttcagggaatattcttgggcagttggctgtgtgagtctgaaattcaggatagaatattaagctgaaataaagatttgggagcttatctacagtcaaatgataattgaaatactgagagtacggggggagagaggtccatgtaccaagaaaagtgaaaatgactaatcccaagcctcgctgaccattgagaatggagctaagtgagaggagttaacaaagctgacccagaaaaagtcataagggccttaggaggccaaggaaaaaaaatacattcactgccaacgagaggcacttacgaatggcttgactggctttgccagcatgcatgaactgcttcataattatttgtattgattacagtaacagatacatattttaacaagcaacttaagtaatacaactgatttttaattatcttgtttaaattgataaaggttgtatatattcatggtgtacaacatgatgttttgatatacccatacattgtggaatggctaaatcaagccaattatcgtatgcattacctcacatacactttatttgtggtgagaacacttagagtatactcttagcaagtatcaagtatataatacattgctgttaactatagtatccatgttgtacaataggtctcttgaacatactcctcctgtctaattgaaattgtgtttccttcgaacaactgatttttttaaataaaaaacttaatacctgtaagttagaattcttaatggtcaccttaggagcctatacaattattcctacgttgttgttactattctgtgtctttttcttttttaacatctttaaaggtatcaaatttttatattttgaaagtagaatttattttttgtcagtctaaaatatttttatgttgaacaaaatgcatgaatggtaaacctagatgcaatcaatttttcaaataaaaaaagtagatacccatgaacatttcttttgtaattgcaaactgtcttgaaaggcagtttcaaaaagagtttagttcctaaattgtaccattactcactgcgttaaaatgcaacattcatttgagcgtataaccttttgatcaatttgtttttgatgtcttgttccctgagagttgtctcaaatagatacatataaatatacacatatctcagattggctctgagaaatgtcttgattcaaacgttcttgattctaagattcatggtacataggaactgtatggtgacaaccttgtcagcctatctttagagtagctttggattctattcagaacatttcccaaagctattctgctatcaagaatataaacaggaatagtcaagggaagctttttaaagggcaacattttcatgtaggcatttttctcacattgaaaactagtttactaaatgcagtgtattaccttctcattacaagaagtctttcacattagtataaatgcatatggcagttgtgccagaaataaattgcctctcaaactagcacatggaaagaagaattctgagatttagcacatatgtagcttttaaatagtatactctgtttcaaacattatgtgttagtccacgttctcttcagccattttcagttgcatttttactttatattcctttgtatatttatctttgctaatcattgtcctgagattcctttagctcttgaattctacgtttttaattaatagaaaactttctttttatttttcccccgacatagttgttttctagaaagaaacagttataggttataaatccaacactttagggccgacttgaacatgcatcaaagctactagaggacttgtagaaatacagattgaatggtcccatgcctagagttttacattcagttacagatagggtaggacctgagaattcacattgctcacaaatttccagttgattttgatggcattggtctagagaccaaaccctgagaaccattaaaaaacaaacaaacaaaaacaaacaaaccaaaaaaaaaactatatacagagattttcttcattggcttttgccactgaagacatttagatgaagagactccacaaagtgtaatcatttagttatgagaggggcctgataatttgcatttctatcaaattcccaggggatactattgttgctgattgagaaccacacttggtgaaacactaattaaaataccattaaaaagcaaaaacaatttaggccagcaaaacctcctaaagaatgaggcctaaagacttattttgttttatttttgccagaagcttcttatgggcaaaattatcaccaacagagctgaggttcaaacttgtgttcatagcaagcaaaagggataatttggaaaaaaagctgaggttagctttgtggttggtttgggagtgggaatgagtagggaggaagaaatttaaaaaaaaaaaaaaaaggaagaagccaaatattaaattgttcacagggcgaaaaaagagaaaaggagtaactagaaatatcttagactggttcggcaagtcgggtccctcgcagctaacagtggtcccaccctctggagtttatatgtttacattctttttttttttttttttttttttgagacagggtctcactctgttgcctaggctggagtgcaatggtatgatcacagctcactgcaacctccacctcctgggctcgggtgatccccccaacctcagcctcccaagtagcagagactacaggcaagtgccaccatgtccagctaattttttgtatttttttgcagagatggggtttcaccagttgcctaggctggtctcaatctcctaggctcaagtgatctgcccacctcagcctcccaaagtgctgggattacaggtgtgagccaccgcgcctcattggagtttgcattctagttgggaaaatagccaataaatttgtgacttattttcctttaaaaaaaaaacttattctggctattgtgtgactataggatatggaaggtgcaagagtatgaggctaacaccctgttctaaattccgtctcctctgagccttgttctgtcaagaatctcctccttctatactttttaagtcaccttcctactgatcctttgctgtcagcttaccactctggtacccttcattttaacaaacaaacaattgtccaagcttaccggtgctgctccttcacccctccacctgtacctagtgtcaattctctccctcttctgatggccaaactttgtgaaactgtagcacagctccatatgtgttcctgcaaaggacatgatctcattcctttttatggctgcagagtattccacagtgtatatgtaccacattttctttatccagtctatcactgatgggcatttgggttgattccatgtctttgctattgtgaatagtgctgcagtgaacatacgtgtgcatgtatctttaaaatagaatggtttatattcctttgggtatataaccaataatgggattgctgggtcaaatggtatttctggttctagatctttgaggagctggaagccattatcctcagcaaactaacacaggaacagaaaagcaaatatcacatgttctcacttaaaagtgggagctgaacaatgagaacacatggactcatggaggggaacaacacacactgaggcctgtcggggggtggggcgaggggagggagagcattgggaaaaatagctaatgcatgctgggcttaatatctaggtgatgggcaatagcaaagacttggaaccaacccaaatgtccaacaatgatagactggattgagaaaatgtggcacatatacaccatggaatactatgcagccataaaaaaggatgagttcatgtcctttgtagggacatggatgaagctggaaaccatcattctcagcaaactatggcaaggacaaaaaaccaaacaccacatgttctcactcacaggtgggaattgaacaatgagaacacatggacacaggaaggggaacatcacacaccagggcctgttgtggggtcgggggaggggggagggatagcatttggagatacacctaatgttaactgacgagttactgggtgcagcacaccaacatggcacatgtatacatatgtaactaaccttcacgttgtgcatatggaccctaaaacttaaagtataataataaaatatatatatatatatctctaggtgatgggttaataggtgcagcaaaccaccatggcacatgtttacctatgtaacaaacctgcacatcctgcacatgtaccacggaacttaaaataaaaattaatcatagaactttaaaaaaagaaaagaaaatgtagcagagctgcctagctcaccttctttacccacagctcacttttcagtccatttatctggctattactcctaccgtgccaggcaaactgctctcactaagaaaatcaatagcctaccccctgccaaattgcctgactcagcttctccttgtaattttctcctttagttctctaacaccctcttccccaggttttcacctgacctgtctccataggacatttgagtctctttcctgatgattcatcctcagcctcttccataataagtatggctgctccccagatcctaccctcagcacttcttcactttccatgccacatctcttctgtgatctcatcttcatccacggctctaattagtatctataagcagatgactctcaaagcatatgctgcctatgtacccctcttggccattctacattgacatctgcaactccccagtgaacttctatatttagaccacaggactggtacctgctgataagcacaggtagggtgtactgagtagtgttttctctatttggttgggcttttgctaaagcagttgtcaaatattttgagtcttactcatggccacagacattttaacattagcatgtcccaaactgaaatcccctactgcctctattctctatttcagaagatggcaccaccatctacccaattatttaagctagaaacttctgattctggtgagacttctctcttttatgcatatgtctacactgacacaaaagactgcaaattttacctcctaagtctgtcttaaagcagatttttctctatgattctctatggtttcaggcccttatcactgtgaagtcaagcatacctgattcgaatcttgtcaccgttggcaaatttttaaatctcttctagcctcagtttcctcataaagttttctgtttcttagggtgactaaagggcttaaatgagattaccatacagagagtaaggtacataaaatgcaattaataaagaatagtcactataactgctgatgatgatgctattactattcgtatcctagaaaactccggtaacttgttcactggtctttctgcatctagcatcacttcctcagccagagttatcttctgacatgaaggctgatgccgtcacccccatactcatgtttgaaattcttcaatacctttaagataaattcccacctccttggtgtagcatgcaaggtcacacatgacataatctctccaaggccccatttcttccactctccttgagtgatatatgtggcagaaaatttaaggctgcctggatattatccaccttacgtcccaatacttccatctgccgcaaagaccttctacccaacttcccatcctcaacgaattcttattctttctttaaaaataacctcaaacttcagactagacctctggtccatagggcattacaaatctctcagtaagttgtacaggatgaacacgccccctaaaactttgtttcagatatttcaatttttattttattttattattattatactttaagttttagggtacatgtgcacaatgtgcaggttagttacatatgtatacatgtgccagatatttcagtgttaaaggtttaataatcacatttacagaaaaggaattagctacaaaatggtggcactggtatacaagtatgtaaagatacagtgcttacaatttaggattattgttgtcgatgttttaatattaaaatggctaatcatacagcaaagtcgaaagaaatttacggtcaacatctgtatacccagcacctatactttgccattgaaattttactatacttgatttattacatattcatctatccatccctctttctgtgatcaatttttaatattctaatactcttacccttaaataataagttatcttttcaaaaaataatgtgtttttacatagatgaagcaaaataaacttgcccttgataaaacaatatgcactgtagtgccttctaattcagtgcattgaagtatccattaacaatataaccagagaatataaaacatgtttattaatattccactgtacctgattagatatagaccattaggaagagttattataattaagaatctaggtttgtcaatatagaaaaaaacctgtgttttttatcccactggaatgtcttgtgaggaatattgttcccctttttctaaaatttaactttgacctttattttgttaatgcaccatgggttaagccacactacgacatgtgctaaatagacctggaagttttcaaactaggtttttaaagtgtatttgacattaaatcttcataacaccttattgattaatttaaatccattaccatggtaaggaaaattcgcagacaggcaggtgaaaattaaaatagaaacaaaacaacatggtaagcaatccttccccccaagccaatcagcatgtagtcagtgtgtccttttaaattagcaaggcgcagcttcccataaagtcccagcttgattttatatgctgcaatagtattgctaaaataaaggagaaggcaacttttctctataatttttttctagaagttttcacgcagcttagtatactgcaatgaccacattactcagttccagaattagcagcattccattgtgaatgacttaattcacattgtgattactcatttaacaacattcttgagggtttacaatgtgcaaagcattacattaagtcgtgtgtggcagaggttctcaaatgcagatgatctgtgaagaagatttcctcaataagcagagaaatgagaactataaggacagaaagagagagagagagaaagagaaattatttaagcttgtagcttgtcatcctcctttcttaggacagcctaccatttaggctgagactatgtctttctgattatttcttgtggttgaaataccccttccttaacaatatgatggtaacagtggatggtaaatcttgttttgttttaatagtttacctggcaaaagtatcattttatgtctgtatcagttatatataatagtatatcagtccattaccaaaccgcctcaaaactcagtagcttaaaacagtaggtacttcttgagttcactaatttgtgggctgatggtttacattgggtagtttatctgctctgactgggctcccttgggaatctggagggtagctgagagcttaagtgtctgaaagtggctgggtcaacacagctctatcgctcacatcttgaacatccctccagcaggctaaccagcccgagcaagtcctttttgtgaaggctgaggtgaagagtggaagtgcaaacatgtaaacaatttgttgagcccctgcttccattaagcctgcaatatccgattggctaaagcaagttttatttccccctgtggtaggcagaatcatgggcccctcgaagatgttaatccccagaacctgtgaatatgctgtgctccctggcagtagggaattaatattccagacggaattaaggttgctaagcaggtgactttgagatggggagattttatggactattcagatgggcctaatctaaccacagggttcatataagtgaaaatggaagcaggagagtgggagtcagagagatgaagatagcccctgctggctttgaagatagagaaaggggccattagccaaacaatgttggtagcatctaatgctggaaaaggcagggaaatagattgtcctctaagcttcttcagaaggagtatagccctgccaacactttcattttaatccatgaaacccatttcaaacttctgacttccaaaactataagataatcaatttgtgttgttttaggccagtaagtttatggaaaattgtcacagaagcaataggaaacaaatatacgctccattgttcaatcttttgaataacacatatactattatttacttaatgtttttcttaaaatcagctcattttgttttctgcttttagccttaagtgataattcccacaaaactgtagtctgatgttgcagtgtttttttccttaatacagataaaactaaatgaatattaaaatttaaactataagctgtttatctgtgtaacatggtaaattggctccctaccactactgttcagcaaaccacattttgggaaacagcgatttaggtggttcaaaggagcaagtgattgtgcaagaacaagaatttattagagaaagaagcatttggccaatgggtagaattgttggcagacaaaggtagaagagaaagacaaattattcagtatggctctagcgaactctttgcacttttatcacacaatctgaagcttgctaatcttgacatgtcttaatgttgttggattgctcattaaactggctgaaatgttcacaaagactctcacctgtcttctggcttaagctgagatttatcacacttcttggaaacatcttctggtctccagatctccctcagctaagctatacagtcagtctgttctgtaagaaagcccaaacttctctgcagtgttcctcagtctttttgatatcatgatgaacagattaagttgatgtgttcatcatgatatcaggtaagctggccgaagactctaagctgcctaaccatcccagggctgagagggatcgatatctgaagtacctataacccaatcagggcatgtgccttagcatacccattggaaagccctgttttagagcctttatcagctgtgaacttattgaaggcaatgattttgtcctgttaatcattctattcataattttcaacaagatacgtggttgttgttaataataattgttggttgaaatgaagttaaataaatagcaattgacttttccaaggtgacgcattgcacagatttatttatcttccctttgctgccctggagtaccagttgtatctaccaataagcttcatttataggccagcctcatcttagtttctgaattagtctaagtggctctggtagcgcatcaaaaatcttgctttctgatggtctttgtaatttgaattctgtgacttacagacttggtattcaatatgtcaggaataaacctggggtgtgcccaaatggtttgaaaaatcccagccttcctgatttcctctcttctctttctcccctggccaccctaatagtctgatagtttttgttatttggatactcctaaactcttggcaatttttcttacatctgttctctacaggctgtcacaagtgagtggaggcaggatggcatgggctgcagtggaaagaccaagaaaataagttaaaagccctgggttccagtaaatgctctgtagtgggatttagggcaagtctcttaacttctctcagcatcaatctccgcatctgtgaaataagattaatgacacctgtcttgcctatacttcaaggttgttttgaggttcacatgcattttccaccccatatagcctataaatctctgatgcctacagataacctataatgttctccagtaagtttaatatttccaggattttaaaactcaatgactagcactgctctgatctaacataacatattgtgtcaatatgtgtgggagtctctctggttgatgttaatggaagtttgtatagtttacctaaaatagaataaagctataatattaatatatatcatcgatgtgttttaggtgatttttttcaatataaaggcaattttggttcaaaattaggtagaacatttaatttttactaatttacaaataaaatgataacatcaaaagggccccttcttttaaagataagttgtaactctcacattgatagtaatctgtcatttaggacagggaatccatgtagtttgaaaattcattggcatcatggagctaaaacagtggctttttaaacatgtcgatttcagttttctttgttttacaagtcaagtagtgatattactgggtacatatgaagcatactgattgaccaaaaaatagtaacaaattttgtaaacccttcacttaaccattattcacctttcccagccacataagaatcctttctctttgtccttagattaattgcctttctttaaccttttcaattctaagtccagacaagctgctgtggttctttaaaaggccacacaaaataagtattgtccagtgctaacactctgaaatgtgatattgtaattactaccaagtgaacattaatcactactagattagaatggaattacctgttatattcacattaatagcaaatgagctttccctgattgatgttgttataatgaatacaaaaggaattaatagtgatctggcactcaccaaaagaggggtagtcattaaggacatgccatcaaaaggcgggtaatactttacaaaaaacaagtattaattaaagtaatatcacaacgaatgcctattgaataacttatatccacattacaaagatattatatggttgcgattaatgtgattgcaatacattttgtaaaaattaataatgactaaccctttaaaatatttaggaagcagatatttgtttatatttgctaaatagctatgccaactctttagcttttgtgagtgacttctagcataggaacagtgatggataatatgaagcactatatataataactcatcggccgggcgcggtggctcacgcctgtaatcccagcactttgggaggccgaggcgggcggatcacgaggtcaggagatcgacaccatcctggctaacacggtgaaaccctgtctctactaaaaacacaaaaaattagccgggcgtggtggtgggcgcctgtagtcccactactcaggaggcagagcttgcagtgagccaagattgcaccactgcactccagcctgggtgacagagtgagactctgtcaaaaaaaaacaacctcatatatttttacttgaaaacatacattttgcctttaggatttttacttgttagaatatcctaaaggacctataattgtaaatgtaaaattgactaatttctgggttttaaaaaaaagtatttgaaagctgatctgctgtgaacattgaaccagatgttaagaaaaatgctagtaagaaatgagacttgggagcaaagaagcagaactaaacttttcatatatggtttctatggagtaattgagaacgtacatattaacagggatacaaagtcaggccctctcattcaagatgctttctgtctttaaaaaaaaaaaaaagtaatttttgaaattttctgtggcaacagtcccatagcagaaagcaaagagttttgaattaagtgatcagaatatcattcttataattttactacactgaacattatttagaaaattttgaatgatattaaaaccgctataaaacatacttgcctaccataagacttaggatttaagccagattaaaataaatatttatttagaaggatgtatgtaagaactggtgaaatataaatgaggtctgtatttgagttaatagtattgtgccaatgtcagtttcctagctttgatgataatgtactatgggtatttaaaatgctatcattgggagaagctgggtaaaaggtgcgtgagaagtctctgtactatatttgcaagttttgtggtcttaaaccatttcaaagtaaagttattttagaaaatatctaaatatatattttagaaagtattatctttttctctgtaactagtggctaattagctcagtctgaaagagtatgtagaggtggaactgctaaatatatttctgatctagacttacttgatgatgcttgaattagtaagtgaatgttatgtgccaacatatgctatgatacatataaatatataagattaaatgataggagctaattatttcttggcatgttgcagtgggtccatttaaaactgtttatgtaggaaactactgtaattataaaaatgagcacagcccaacagcccagtatattagttgaaatataaaaggcgttgtgtccaagatttgaaatgccttacaataagcttggcacttacttaccttcacacaaagcagacacattttattgtgattttagtgttccatattatatggtacagtaccaaaggaaaactctaaaatatgtactcaaaatcctgatgtgcccttctttccaaacaggtggcaccacaatgaatataacctttagagttaatatctgaggacaaacccagcagttacaccagcatgatttaggtcctgctgttacaattattattattgtatttatttcacaattaagttgcagagttgagctcgatatagttccagctgtggcttttttttcaactgtctcaatagttcatagatatggccaaatgttcaataatagtgaaagcttatagtccacatattatttctgtagcaccaattttatgtgaaaaaatgatttatctaaatctcagagaatttccataactagttttgttatacatctacaaaactaagttaaaagaacagagcagactttttaaatagctagattggccaaatccacctcattatcatcaagaagatactgaaacaccgtgtttatacaacaagaccaggcattgtaaaagaggaggaaaggtagagacaaaatttatttagccctcaggaatctttcattctgatagtgtaaatttgacaactttagagggacttattaacatgtatcttatatatcttgataccgaatatatattttgtgattgcattagagccatgaaatattacacaggtcatttgaacatagcattttcatagagaaggtgacatttgcaaaagattaggagaaaagtaactacgattagaaaatcgtagttttattttgtctcttgagaatgaattgatgttaattttatgtctgatttggccaaatacgatgtggaatttgctaaagactgaaaaaagaagagacatcaaatagagggttgcaagttaacagaccatgttataattaaatgagggaaaaaaaagtagagttgttaaactcccagagaagtcatttccccttggtttggtgcatttcactttggtggtgaagtaaatgaccatatgggcacttttctagctctgtccgcaggtagcactgggtatttgtggacaaattacctagcttttcatagcactagtttccttgttgatagacttcagaattctaaattccattttacatccttatttctatgtttaacttaaagataatcctttgcagccgggcacagtggctcacacctgtaatcccagcactttgggaggccgaggcaggcggatcacgaggtcaggagatcgagaccatcctggctaacatggtgaaaccccatctctactgaaaatacaaaaaatcagccgggtgttgtggtgggcgcctgtggtcccagctactcaggaggctgaggcaggaggatggcatgaatccgggaggtggagcttgcggtgagccgagatcgagtcactgcactccagcccgggcaacagagccagactctgcctcaaaaaaaaaaaaaaacaaaaaaaaaaacaaacagatcatcctttgcactggaattatcctgcagtggaggatagtaatgaaagtgtagactctgtttctgaacactagctatgtcactttcaaactgtgtgattttccttcaagtttctcaatcactccaggtctggtttctaaatagaggaataggagtagagattaatattgtgaagattaaatgagaaaacttatataaagcacttagtacggtgccctgcatattgtgaaggcttggtatgttgttagtagattcattttattatcattattaataatactgaaccctggctgttgggggaattggttctatcctcctgtctcatagtcaaaataggttaaagggccttctatctcttatttctggtggtgcattataattactaatagtaatgtgcttcatttgtatatgatcctttatagtttacatggcgctgttttatgtaatcttactaaaatttcaaaaataattttaaaaagccagaattcacaagaatgtgactcggagaagaagtagatgtttttctaagtagatctttcagtttaactgattcaaattttctcatgtttcatatacatgattatcatgtcttttgataaacagaatgttaaccagagtacaaccttgtatgaacatatttattcagcttagaaaagatccagaggtacaaaatctagatcccagtgtagaagttagcatacacagtacaatttctagtatgtccataaacaatatgttaaagtattagtttgagccatataggattgccaatatctgagtgttatagagctacaaaattagtaggaaattttgttgctttaacctaatcattaaattagaattgtgtgacttaaagttacaaatggtttccgaatattttgcagtaaaaaagtagtgaggaaaataaatataaatactaaactagacctgggaaatttaaggctataaagaattctagcttacagagagaggagtctttgtttgcaacctcccactagctaaatttaaattatcacaaatttcatcctctcctttacttaacccttgactcatgcaactagtcaaatgtctttttcttgctaattttttctttccatagatcacttatagggagttctggttaaaaatgatgtctctttaaccttcactaaaatgagaataggggaattaaaatgatatttaccacaaagagaaaaaaatctgggaggaaaaacaataaaataaaaaagataaaaaatttaggaatatgcagagaatggaggagttagcatatcttggaaacctgaattccaagtacttagaacttgggaagtcctagaaatgtgaagcaccagctactgcagaaggcagagatgaatgtgaggtaagatagtgagactgtgaagagaaatcattcagtaaaaaatgcattatcaagccaactgccactggtctagtggagtttaatcccactggggaaattctaaatggattgaagacatgtgtttaagagttagttattctttcaaaggggcaagggagctggggtatttatacacaaaatcctgctagtcattggtttaggactgcttccaacgggggaattattttcctagcatttctggcataccaccttggcaagaaaaattattttgtgtccagagtatgtctaaagccattagggaaaaaaaatgtggatcctcatagttgaaagccaggccagtctgcactaaagtggtaaggatgttttcttttagagatacaggtctaagaaagaaatctgaaggtggttacctcttatgcaagaatttaatttgatggattcaaggtgtgttggttaagagaaatggggaagggttgcttctcatgactgcggcacgattctactatactaaatttttcttttattaagcagcattgccttatgcaatgataggaaacatttgttatatgtgaaatcacttttatttttattttttaatctattcctattcttttcatttttttaacttttattttaggtttgtggggtacatgtgaaggtttattacataggcaaaccggtgtcacaggggtccgttttacattttatttcaccaccgaggtattaagccaactactcagtagttatcttttctgctcctctctctcctcccggcatctcttttaaaagaaaataatttttagcaattctttagaataagtcttggccacctaaaggtttccaggactctagttcagggagtatttatctaagtcagtagttcttaacctgatataatttcatccccagagaacatttgacagtatctcaagaaattcttggttgtcacattgggggcggggatactgctgtcatcaagtgggcagaggccagggatgctgctcaacatgttgtaatgcacaagacagccccccacaacaaagaattatttggtccaatatgtcagtagtgccaagtttcagacatcctgctctaaatcaggactgtgatgtgaattctctgcgatgatgaagatattttatatccgtgatgtgcagtactgtagcatatggctactgagcaattgaaatatagctagtgtgactgtacaccaggtgtgatgttccataccgaggaaagaagtagaaataagatatagtctttgaagtcagagctcacaatctagtagcggagacagatttttaaaaattacaatattttaaaaatattgcaatagaacatggtaatgttagaagattaataacatgctaaatttgaggcatcaggactcagacagacaattaaaaattctctgaggtgaatttccacccttagctcagaatactgtaatgtttaaaagctgttttctatacacacacacacacacacacacacacacacacacacacacccctttaaatcttttatcatgtaactcattgcttcttattttacccttttgtcagagaatacatataaaatactggaatctgatgggacattctactttatttaacaatgctattgagtttctcaaaatagtttcctaagaaagtctattaaagtattgattttttcataaaggataatacaaatggcatgagtctgtttaacattttaatcaagcttaaaattagtcttgcatttgaaacaaacttgcccagagaaattgttgagaaacttaagagaaaaacatcataaaaaattgatgggccagccaggctgtgagaatattaaaatccaaatctaaattatggttaaccattgtcacatctttctttgaagcttaagtaactcgatattccctgtaggatacccagtgattcaaagtgacacatatactgtcagctcattttccttcccagcatgctggtacaatttgtatccatagaaatatatggaaaaacctattagtcttgagtgccagaacctaccaaaaggaatctttgtcatctacaaataaattaataacataagataaacaatcctattaagttatactggcccgaaaagggaaaaaagaccagtttatgaattgacaaaagaaggtaaatgagattagccatatagcaaccactcagataataatgtgttttctctgtttagtaaaaaagcatatttgagagaaaattttcccttatagaacaattcttaataatatacatagatactcctttcctgggatgtagagtttaatcctcccctaagcccctccatgaacttggtaacttacttccagataatagaatatggaaaagtaggaataacaatggagaagaaaccaggcaggcaccaagttaactaagtagtcaagtataacatcgccagtgataataatattgatatcatgtctcctgtgatatgatgtcatgaaaaggacatgttatctctctggtattcttccccaaaacctgtaacttcttctaatagggaaaatacttcagtcaaatcttaagagacttctagaatatacctgactagtcctattcaaaagtttcaaggtcatgaagaacaagaagaaactgagagactgtcacagactagaggagaccaaaaagacccaaggaccaaatgcagtaggagattctggattggatcctgaaacagaaaaatgacatgagtggaaaaactggtgaaatctgaataaagtctgtagttttgttaatagtgttgtatcagtgtttgtttaaatgtttagataaatctctcatgcgtacagaagagttatcattaggggaagctgtgtgtcaggcacttagaaaactttcagatacataggtaccttttgtaagtaaaataatgaattaatgggtcattttatgtctgtattttatataaggctacatttctaaagagacaaaattgtgagtcccataaaaatataaaatgaatatgtgtaaaacattttattagatcattaactgatgaaggaattagtaagatgttagttacagttggttcaaaggagagtctgaagaattggcatatatatatacgtatatatacgtatatatacgtatatacatatatatacgtatatacgtatatatacgtatatacatatatgtgtatatatatattttatatatatacacatatatatataaaaaacactctagaatgctgataggaattttataacagatacaatactgatcactaactgtagggcaggaatctattgcgttccatgagaaaattttactggcatctagtgaacaagaatcatttgtgtcaccatcagccctccacaaattgacttttaaacgtacagaattgcaaaatagcataaccaaagtctaaggtacagactcttagataatcagataactcctaaggttttcctaaggaattaaagggaaagagacattctcagattaaggaaaacaaagaatttcttgctagcaaatctgctcttaaagaatgacaaaaagacattctctaaacagaaaggaaattataacgaagtcttgacatttcagaaagaaaatagtagaatgggtaaaaatgagagtaaaataatagactatcctatttaccataagtttgaagtgaaaactttaacaccacctgatgtggttctcaatgtatgtagagaaaatacttaagagttatattttaaaagaagacatacctaagtggaagtaagagtccttctacacgtcacctgaagtcaattccagtagattgcaatgttaatgcgtatcgtaatgcctggaaagaccactaaaaaactatacaaagtgatacgttaagaaaatacaacaaataaattttgatggaatcttaagaaatgttcaaataacccacaagaaggtaagaaaaaagaaagagaagaatgagaaataaagaaaacaaacagaaaccaaataaggtggcagattgaagccctaatatatccataattaccttaaatgcaaatggtctaaatataccaattaaaagagatttagctgagtggattgataaaagctgagcacacaatatgccgtctaaaagaagtttatttcaaatacaacctaggtaggttaaaattaaaagaatcgaaaaagttacattatgcaacaattaatcaaaagaaagcagcagcagtaatgttaatatcagataaagtaggcttcattgcaaagaaaattactagtgacaaacagggacattacataaagattaagtgttaattcactgggaagacataataatcctaaatgtgtttgcacctaacaacagagcttccaaatacatgaagcaaaaatgaatagagctgaaaaaagaaacagacaaatccatatttctagttagggacttcaacactcctctctcttcagttgatagaactactaaatggaaaataagcaagggtaaagagaactgaacaacaccatcaaccaataggatctaattgaagcactcctcccaacagtagcagaatacacattactttaaagctctcatgaaacattcactgatataagccatattctggactccaagcaacttcagcaaatttagagaattcaacttatatgttcccagaacataatgaaaccaagctagaaatcaataagagaaagacaaaagaaaaacctcaaaacacttggaaatgaagcagcacacctttaaatcattttccccaggtcaaggaggaggttgcaaagaaaaattttttaaacacaaagaactaaataaaatgaaaataaaacatcaacatgagtgagattctgaagcaaagggcaagcatatctactgtctatttttaaagattaagcttccttaagctcagggtttctctcctgtgatgcaatccactgtgtgtacaggtgtctcctgaacttctttgggattactctgtgggaactggctcaataaaatgttggttctttgactactgctttgctgtgagtaatctagtctttttctctggcaaaaaaaaataaagtgagatgtcataaaagcagtattgagaataaaatgtatagcattagattatttagttagaagacaggaaaggtctaaaataaataaatgagcctagagacaaaaaccatcaacaaaatattaaataacatgcgtcaaagtttaaaaaaagagtgtcataccataactaactgggatttagtattgaaggctggctcaacatttgaaagttaattagtgtaatctaccatatcaacaaactaaagaagaaaaaatcatatgattatattgattgatgcagaagcatctgacaacacccagcatccattcatgataaaaactatgagaaaactgggaatagaggataacttccacatcttaataaagggtatctacagaaaactacagttaatagcataattttaataatggaaggcttaatgtttccacccatgattgctaattagggaaggatgcccaatttcactactcttttttaacatagttctggaagttccagacactacaataaagcaaggaaaaacaataaagcatgcatattgaaaagtataaaataaaattatttctatttgtggatggcatgactgtgtacgtagaaaatatcaaatattctacaaaaacaaaagcaaaaataaccaaaaatgctcatggagctgagaagagaggttaacaagatccaaaaatacaagatcaacacaccaaagctagtcacatttttatatacagatgctcctcatcttatgatgggcttacatttagataaacccatcataaagtcaaaaaatcataaggcaagccatcacaacttacggattatctatgttggaaatgaagatgtgaaaagtgaaattaaaaacacaacaccatttataattgcttatccaaaaatgaaatacgtaggtataaatctatcatacatgtacaggatcggtatgtagaaaattataaaatgctgatgaaaggcattaaaaacaacctaaataagtggattatatggcatgtttatagactggaagagtcagcatagcaaatatgtcagttcttctcaaatcaatctaaaggtttaatttagtttctatcaaaatcttatcaaggatttctgtacacatagacaagcatactctaaaatctataagaaaagtcacaggccacagaataactaaaacagtcttttaaaaaggtaaataaagtgggagtaacctctctacccaatattatggctaacaatatagtaaggctatcaatacagtatgatgttgctggagggatagactcatagaccaaatgaaacagaatagagaacccaaaaacagacccatgcaaatgtgcccaacagatttttgataaagttgcaaaagcaattcaatagagaaagctcaccttttcaacaaatggtcctgcagaaattggacatccctagagtgggaaaaaaaaagaacttcaacctaaatctcacaccttgtaaaaacttaattcaaaatagatcatggacttaaatgtaaaacataaaactatcaaaatttagggaaaaatgagaaaatcttcaggctctagggctagaattggcattgaaagcatgatccacacacagaaaaaaatcagttggactgcatcaagatttaaaacctttgcactgcaaaagacctgtgagggaggatgaaaagacaagctacagactgatagaaaatattttcaagccatatagccaaaagatggatgtctagaatatataaagaactctcaaaactgcaaggtaaaacaagaaacaaacaatgcaattaggaaatgggcaagacacatcaagaaacgtttcaccaaaaaggatatacagatagcaaataggtgcatgaaaagattatcaaaaacattagccattagagaaatgcaaattaaaattattatatattcctacacatctatcagaatggctaaaacaaagtagttacaacaccagatgctagcaaggatgtggagaaaatggatcattcacatattgctggtggaaatgtaaaatggtacagccactgtagcaaactgtttatcaattttctgtaaaactaaacatgcagctaccatacaacccagcaattgcactcttggacatttatcttacaacctgtacaaaaatattcataccaccattattcattatagccaaaaactggaaagaacccagacggtcaacaatgaatggttgtacaaactacggtacatccatacataccaggcaatactattcagcaataaaatggaatgaaatatttatacatgcaacaacttttagatcaatctccacagaattatgctgagtaaaaacagctcatctgaaaaggttacataatgaatgattctgtttatatagccgtcttgaagtgacagaattaaagaatgaagaacagattggtgattgcaaggagtccgggacaacaggggaaagagagagagagagatggatgtgactccaaaagggcaacacaggaggcatccttgtagtgttggaactgttctttaccttgattgtgtcaatgtcaatatcctggttatgatattgtactatatttttgcaaggttttaccttcagggagacggggtcaggggtatactggttttctctgtattatttctcacaactacatgtgaacatacaattatctcaaaactaaaagtgtaatttcaaaaaacaaataaaacaattcagaaattttaagacttcaacagtcatttatctcatttgttattttactgttgagaaaacaggcacaaagaaactgaagtgacttactttcatgcttcacctaagtctttttttcttttctccatcactcagttaagagcttctgtaatacagaaagtatgtcttgtattcttttaactcccatattacttcaagcaatgttgaacacatgttaacattgtaaaagttgttgtctgagtaaatgggaaagatagaggtctatgtctatatgcaaatactttgtattaacatgtttcagtctgatataactttccacacagaaagtacaaaagaagatctgttcaagttatctgatttaattaagatagtaaaaagaaagctgataatttagggggtcttatttgattgtttttaattttacttattttccactaggtgatcattttgatgattcaaaaatgaaaatttacaaaaaggtataaaataaaaattatttctcctacctctatgcactgtcgaatcaattcccctacccaccaccaatcagtattgtcagctgtttgtatatccttcaggagatatgtacgaatttcaagcgaatatgcataagtttatgttatgtatatgtgtgtgtctgttttctatatatatgcatctttacattaatggtagcatacgatacacattttcttctgaattatgcttctctctcaacaatgtttcttggacattttcctgtatcagtacataaagaatgtatttgtttcctatgactgcaatagtgaaataccacaaactggatgacttaaccaaaagaagtctgttgtcttacagttctggaggatagaagtctgagatcaaggtgtcaggagggttggttccttctgagggctcggaaggagaatctgttccattccattcccctagtttctgatggtttgttggcaatctttggtgctccttgtcctgtagatgtctgccttcattttcacatggcatgccccctgtgtacgtgtctgtctccaacttccccttttaaggacagagtcatattggactcaggcccaaccaaatgacctcattttaagttgattatctctgtaatgaccctatctccaaatagggtcacattctgaggtaccaggggttaggacttcaacatttaaatttggagaaaatttggacagaattcaacccatagcaaagaacttaaccgttagtttaatgactacatattgttccattttgtggatgtatcataatctatttaagcagtgctctgaacattttattggttttcactttcattgttttgccttaatattggtgtctgtttcatagaatagatttatagtattttaggcttatcaagattttatttaaatcttggaatttaaattccctgtaaatttcaagtgccttgaaggcaagatatattgaggaggggagacttttaaagttcatatgaaataataaataatcgcaagtatctcaggaatgcatgaaaaataataaatgtctctgcatcaataataagggagggggcttgccttatccaatattaaacttgctgtaaagctactgtaatccaaatagtatagtattagcacaaaacaagacaagtagatcactgaagcaaaattgagagtccagaagcagatcagattgtttttggaggccgggcatggtggcttacgcctgtaatcccagcactttgggagtctgaggtgggtggattacctgaggagttcaagaccagcctagccaacttggtgaaaccccgtctctactaaaaatacaaaaattagctgggcgtggtggtgggcgcctgtagtcccagctacttgggaggctgaggcaggagaatcgcttgaacccaggaggcggaggttgcagtgagccaagatcgcaccattgtactccagcctgggcaacaagagcgaaactccatctcaaaaaataaataaataaataaataaatagatacaaattgtttttggaaacattatatggcaaatgtgttattttaattcaaggaataaaggtgttttattcaataaatggtgccagcactctttgcaattcctcttagaaaacacagattgcctcctagcttatgcaatgtaagaatacatttcaaatgcattaaagttttaaatgtaaaaacaaaaattcttggaatgaggaagacgttttctaaacaagacacaaaactcaaaagctataaggaaaaaatataccttgttactgcttaaaataacagaagacaaagtcaaaagaaaaacagcaaatagagtagatgtattcgcaacatgtgacataaagagatgcatatacctaatatacaaatttctcctacaaatttgttaattaaattaatattttttaaaattcaaacaacccagtacaaaactggccgaagtataggaatatgcaattcccagaagaggatatccagatagctggaaaaataaaactatgataatatgcttcctcatagtagtaagggataggaaaataaagaaataagacaccatgtctatctaacaaatagacagaaattaagaatgataatttttaatggaagagagcactctcagatattgcagatgaaacgcaaattgctgtggtctttgaggaaagaaatgtggtatgatctacaaaaattttaaatgcacttaccttttgatcagtcactccatttctgagaatcaatactacagaaataaaagtaccagtatgaaaggctgtatgtagaggatgtgtattttggcattgtctatgatggtcaaaaagtagaaatcaagcaaatacccttcagtgtggaaattattgaatatgttatggaattatttgggcatcccagaatgaattattatttagtctagttagagctgtgtctactgtcctgaaagaatggtgatgatatctttcaaaaatcaaaacaagtttcaattaacatattccatttttaaaataaaaaagataaaattaatcttatgggattacataaccatgaaggaggaatggagagatatatactaggttatcagtatttgttaccttggattttcaaaggagaatgaaagaggaacaaataatgtatcaagtttcacaaaaagtgaaaaggtggaatataaatattactgcaaatatataaccattgaatatgtatatggacaaggacgataagataatatagaaaactgaatatgttggttttattatgaggtggttggattgaagatatttttgtctccaaatactgttgttttaatatgttgtgttttacaaagaaacatgggctgagcagacagggaagccctgataagcatagtacctgccatgtggccattcaataaatgatagttattgattattattattagagttgtagtacagtagtgcctaccttaatatatttagattgatgcccagcagcattgagttaacccgcattttaaggacaagtgttatagctattatatactaatggtaaacttgagtctgtaactagcactgttgaaggaggacaacagagtaatatgatgtgtattggcctggggatggaagggtggtgcttaaggcacagcagattttcactccagccaggtttccttaggacctctccaatgaacaggatacctcccttcctgttctttctaccctcccaccccgttttttgctttttcagtttcagcccaaaggggaaggaagtatgatgactgactccccatcagtccctgaggtgaactgggattttgggagagtgtggcagctgcaaatttggcttcctggagataggatttttgccctcaatctggagaaagttcctgaggctacagctgttcaagcttgtgaagtaggaactttgatcccttttttcaaaagttttgtataattagcatccaacttgttagacagtatgtggctcattacaagattgccacaaattcatgctgggccgtgtctaagaacagggcaaagggagcctttggaaagtgttatacagttgaccctcaaacaatgtgagggttaggggcgctgagcccaacacattgaaaaatctaagtagaacttttcactcccccaaaacgtaactactaataggctactgttgacagaagccatactgataacataaagagtgattagcgtatactttgcattgttatatgtaatatatactgtattcttgcaataaagtaagttagagaaaatacgatgttactaagaaaatcataaggaagagaaaaatatatttactattaattaagtggaagtggatcatcatataggtcttcattctcattatcttcacgttaagtaggctgaggaggtggagggagaggaggggttggtcttgctgccaatctaaatgctgggcccagccaatgggtataagttttaagtgtgcacatattggtgaacccttacagatcacggcactgtctgttcgagtgtctattttgaaatgtccctatccgtaatataagttgcaaaggagtttgtgggcccactgaattctaccaccctgatcattgtgaagcccattcagctttgtgaagagcttatcttggtactaccttagccaaggtatgataactcagacataatgtcttttctttcatggttccttttttagtgatcatagattcagttctgtaataattagagatttatgtgtcctattagtaattgcatcattctttaaagacagtgtcaaccttgctatacagtgtgattgaagccttgacataacttgggggtttgttggcattttgaaatcccaggccccacttcaaaactgttgaatcagaatctgcattgtaagaagatccccaaaagatctgcatgcacaagccttgaaagagaagagaagccatctaacattcctcacctaagatttgaagaatttcccacttatgcaagagtaggggtgtgatttctcaggcaggatatctaacagaaaacaacacttatgaagtgtttcctgtaggagctaagcaggtggccagaaaatggcaggctacaaaggagaagaatgactaggaacctgagcaaggagaaagtctcaaagacaaggaagtggctggcagtgtcagggactaccaggcagctgaaaaagctaggtgtgaacactatttcttggagttttcagcaagtaagaggttcatgatgatgcctcaaagaatttacagtggaaccagagccaagaagtcttattgtggtgagttgggaattagggaaagtgttatacagttgaccctcaaacagtgtgagggttcggggcgctgagccctaacctcaagtaagaggttcatgatgatgcaatcaaagaatttacactggaaccagagccaagaagtctttttttttttttttttttttttttgagacggagtttcgctctgtcgcccaggctggagtgcagtggcgcgatctcgactcactgcaagctccgcctcccgggttcacgccattctcctgcctcagcctcccgtgtagctgggactacaggcgcgcgccaccatgcccagctaatttttgtatttttagtagagacggggtttcaccgtgttagccaggatggtctcgatctcctgacctcgtgatccgcccgtctcggcctcccaaagtgctgggattacaggcgtgagccaccgcgcccggcagccaagaagtcttatggtggtgagttgagaagtagggaggtggaaataaggaatggagatgaagacatgaaaggaatttgagaaatgaggcaatagctagagaagaatataggaatacacagatccagcaacccagcaagggaagggctagattctgatttcatgagcaaattgcctactaattaaattcacaatatcagaggaaactgttggactcacttactgaataatagctgaaaagtatctttgctttatagagagatcactgtagatgaaagtcatcttccagtggtgagatattcttcagtgtcatctcttcatttttatttctaatttttcttaatttgaattatttcttctgataatgggaatgatgtggtaattttgtctctcctgtaaattattttaaagatttgtacgaactcctttggcaggcttgagtgtgttgtgacagcttggcttagatatgcattgaatgtcattgaattcaaactccttaccaacatagttagatagcccataggcattctacttgaccctttcaaggagatctggagatgcaattgtaggggaaaaaagaagaaaagaattcaagaagcaacaaagtgaaagataatttggcttgcagaagagaggtctttctatcacagtaataataatgccaattatatgtccatatatatatatacgcacacatatatatagtatatatatatacacatataactcagacataattctttcatagttctttcttttgtgcacagattcacttctgttataattacatacttatgtgacctatttgttagtaattgcttcagtttcttaaaagagcatcaccttgctgtgcaaagtgtgattgaagcctcaacatctcttgggagtttttttagaattttgaaatcccaggccccacttcagaactgttgaatcagaatccgccattgtaagacaatccccaagggatctgcacgcacgttgcagcttgagaagcactgcagtatcacacatatacacacatattcaacaccaaagagagagaaagaggtcataagctctcaggtggagactagttccatgtatatatgcatagagagaagaacaaactctaccttccagcaacgtaaaattctactcaatcatgtattcaccaaaaaagaaaaggctttctccatataatgtgtattattcatatattggcactcttcagagctcttcattccaccctaatgttatctttcttagataattcacatgacactttgttatcttccaataatttctgtcattgttataagcgaaattattcaggctttatctaagagagtaaatcaaacagtatgcctctctcattccaattctgcaatattttcattctagaatgtctaaaggagccttgaaagagaggagaagtcacctaaggccagctagaggggatatatagcagggaatggtggcaactccactcctcgtagcccagtggggttttttttttttccaatctgtatttgtatgtgagtatcacgtctatgccgattttatgtgtacatatgtaactcaaatctgttcattgtgctagttagaatcttatttccccctcttctactacactctaccctttctctttcccctcctttggcaaccaagacactgagttattaataagcagattggagcaaacattttgatgcactattgtttgatagatttgttggttcattcaataagcattaattgagcacttgctaagtgttaaacaatgtactaattgctagatttaaggatgaaaatgataaaacccttggcctctagagcctagagtgtagttggggagacaaatgggcaaattagtcacacgacaacatattccttgttaaaacagacagttgtgcataagtctgtatacccagactggagatgactctgtttccaatgttgccctgggaaacctcatgatcagtttaataatgatgtttggggtgagaggatactgagacagtttgcttctagcatagtaattacccatagaagtttggggtctttattcaaaagagtttacaggccacatgagccactgtcttgccttttataggatcacatctaagttccgtgtcatataatggccttggccttcttggctttctctgtgctctttgcctgccaataccctaattattgaagtactgtctcccgcagctcctcaaccatgagctgttcccgatcctcccagcagctatgtttctcctttcttcaaacctctttagctttttatttgtactttatttgtactaaattgtatttagagctttggagaacattcttcatagttgtaattagactgtaaagtcctgagaatgtatttttcatcttcgtagccccctgcagtatctagcagaatgcctttaaacaaatgggcagtaaataaatcccaacaaacttaaattaaatttctccaaattgcatatttaattttatagtggcatttactgataacatacattgaaataaaggccagagcataatcctctctgtttctgaatattatttatttaaatattaactttctaatccaattaggtctttcaatgacactttagatctaaatttatttttgcattgttttaaatgtcatcaaatgattcatctcttgtgttttttaatatttttggaacgaacgtgtgaaaatgagcaagtgtcatcagaatatgatgcttgggtttttttaattcaacatttctttgatcatatatttaaagactttttctcaattcctttctggatgtggcctcacaaatcatttcagaagtcaatccatttcaagatttttttttttttttttgcttttttcacttcacaggaagtcaagttcattctttaaaatgtagcaaatgattaagcaaattcaacgaatgatcttcatcaactccgaggtgtttttcccccttgaaaaatttaagttactattatttttttttctttttttttttttttgatacagagtctcactctgttacccaggctagagtgcagtggtgtgatctcggctcactgcaagctccacctcctgggttcacgccattctcctgcctcagcctcccgagcagctggtaccacaggcgcctgccaccatgtctggctaattttgtgcatttttagtagagatggggtttctccttgttagccaggatggtctcgatctcctgacctcgtgatccacccacctcggcctcccaaagtgctgggattacaggcgtgagccactgcgcccggccaattattattattttttttaaacttcacctatcataaatcttttaaaatttcacctatgataaacttcctctgtcatctggggaattacttaaatgcaatgatggccttcaagtatactaccaggcagcctatccaaatcatgaaacagaaaggctcatagaccaaattaaaatacttgaatcacagagtttattaaaatcacagtgagaagcaaacgggaaagatatgtgctaagttaacacgcttagaatagagtgtaagcagactgtgaagattagagtacttgaattctgcagtacacaacattatatgtcttgtctgtctctgtattgcatcagccttcccaattatggtgtgcttacaaggaccaaagttgacttcccaacaagggagtccaaaatgggtggtgcctgattcagtggcatgtggtttatcagagacacagagacaagaatgcatggccacagctgtaacttgccaaaatagcctgatgactagccatgtaattctcaggcagaagacttacggtgctggaataggtatcacctatggatgcctgaattaagaccttgtgaacattaagtgctcatgtgtatttatttgatcttgaatatttagtgcctcttgtatatttggtctcatgtgtatttagcatattatgaatatttagtacccaggtgcctcatgaatattgggtatcttttggtccttctatccctcactatctatgtttagtacacacatgctctgcttgctaactacttatcttctaattaacacattccaagagccaattatgtgtatctctttccactgagttcttcattcaatgacatcaagttagttgcttgaaatcagctattgtgagagcacttacaccacagaaattggcaaatgctacaattagcgccactgccctcccctagagccagttatttgacatttactagcattccactacttacatggcccttcatgctctcactccgtgtgaccactcaagccttatccctctttactgaactctacaatcaaataaaatatctttgtttcttgcttctggccctccatcaaatggctccctctcctaggaacaatctgtctctcctctatcacctttgtttagctagttaataatcccttttcagacagcacctcataaatagattcctgaacatcccaaaccggatctcctgcaccttcaatgtgctacttcagtacatttgtcttaccctttgccatatggtatttcaattgcccatgaatttgtattcctgtttagatcttaagctttgtgaggtctttttgtacttttttgtacttccgtatacctaccacataataaatatttaatgaaagcattaatgaataagtaagtgaatggagtgagtgaatgagtattcaattatgattcatttgtatcaaagtgataacatatacttacagggaaaaggccagagggggaaaaaataaaaaataataatatattttatgtatgaccttgtgtggggaaaggaacatagggccactgcctggcctgcttcttttatgcaaatcctaatgtaaaatatgatcaacgcctggctgggcagaaatacaaaaacccagtactagtgattctcccaaccagataccagctagtacagatcatagccagatttaactactgtgaagtggttaggttagaggtgacctataaggaaatgacgctaatgatcattagcatcatcttggaagcttaaaaaaatgccccagctgtaccccaagccaatgatatcagacttttgtggggaacccagatatcattgtttttaatctttaatgattccaatttagccaaagttgagtctcaacaaaccaagttcttcttactctcatattctcttcttctcgcatagataagaattaacagccagctcttctacatgtttcttagacacatatattgtttcagtggtaattcgttaacagtgcatatgtcagcaaagcatgactgaaaaaaatatctgctcccacacattctgatcccatcttgacactgcatagctgttggcgaaggcaatttcaacaatgaagaagtgggagaaatgactacattttatgtaaatatgtattcattgaaaatcaaaaggacatatgtaatgatattgtttaagattctaaatgaaggacaatacttaagagtcctctgtagtcaaatttctcagcagtaaaaaaacattgtcttttctttacaactattaaccatatggctgtgaaaatgttattctacaagcctttaagatttgaaatctgactttatgttaatacacagaatttaccacacaatcctgtatgatttctaagtagatttaaagagtagctattgctcaccttttcaacataatggtaatgatggtgcaatgtcaattacatgatactctcatgggcgtgattatatgattgttaacacactgaagtgcttatatagacatagatactgatttttatatgtacatatttaaaacaaacaaggacttaaaatggcctgtaaaagtctttctagtcagtctttctggttttggacagagaacaaataatcccttacagctgttaggttggtgcaaaagtaattgtggtctttgccattgcttttaatggtaaaaaaaacgcaattacttttgcaccaacctaatagttatctacttccatctttaacgggccctacccaagactgcatggtatataagtaagaaatgtaaatgaaaatctcaaatgctagatctgcccaggaggggaccactaatgagagaggaaatgttaacgtcccatatgaactaagctcagcttagcatttacccttcctgctattccgctagagcagtgcttctcaaaagttgacctgtaatggaatcttctgaatgcctttttaaaacgtagctggctgggccccatccccagagtttctgtgtcagttggtctgggatggggcctgagaatttgcatctctaacaagttctcaggggatgttgccggcccttgaatcacaacttaaaaacctctgctctgaagaaagggaaagctctctctgctggatttccccaagcctttttcagattttcaggagacttctgtgcggtagcttgcttccttctttccatactactactactaccactactactactacaaatagcaacctctagcatattttcagtactaaatacccagcactatatatacatcacaaaagtcccttgaggaaggtggtattatcatctccattctgcggataaggaaatagataagaaatttgctgaagatcgcagagccaaatgagactcaaacccatgtaacccatgtctgtttgactttaaagcccggaatcttaatttgttccagacaagctcattatgtgctctgatcttcaccactgaaatgttctgaatatgaggctgagggcagcagtgaggttggaaggagcagcccagaggagcaggcactgtgctggtagaatagtagtatggtggggcctgcactccctaataaaagaaggggacaatgactatttcctccttctccaaggtcgtgctgcctcccatttctctgtctgcctggtaagaagcagctctgggccatgtgtggtggctcacacttgtaatcccagtgctttgggaggctgaggcgggaggatctcttgagcccaggaaattaagaccaaccctagcaatctagtgggacttcatctctaataaaaataaaaaacttagctgggtgtggtggcacacacctataatcccaactactcaggaggctgaggtgggaggattgcttgagcttgggaagtcgaagctgcagtgagccgtggtctcaccactgcactccagcttgggcagcagggtgagaccctgtctccagaaaaacaaaaagcagcagctctgaaaagaggatctagcagtttctatatgcaggagagcatttgcgcaattgttcctggggttgaatctgagaaactcacagtgcacattcagatactatttacaatcttctaggaatagtataaatattgtggccagggcaccttcatattgtgaaacacaaaaagacttcagaccttagattatgtgtcgaaagttaggcaccaatgatttttttttccatttgttcttaagtggcaaatctttacattaacatttttggtacttgtctttagggaaatttcttctctgttctgaatgtatatattgtaattcctcatttacaattttgcctgcaaatgcaagtgagtacagatcatccagttatgaaaatgctctgagatttgagtctagctgtttcagctttaagagccctgacctagactttgaaactgacatggttttatatgtatgtggttggaattaaacccaaagcacatcttttaaaactctgaggaacttctgtgccacagctttcgctcagttggtgagattttactttgaaatttaagggatgagtctagtttatatgcaaagaaatgtagggagctttgcaaacccaatcaaatcctttgtgaacagtgtgtgcatctgtttattttgctgtcattttgagtccatgatcctgtatactgttttgtgggcacatattgagggtaatatcaaataccatgtagaacagatgctgcaggtatcctttccatgtcctcttagctttggggtggtagatgggcacatggaccaagcccaaagtgacagggtattaacaggagcaagactcaaccaataagggagagtagatgggtacaaatctcagctttctctcccctcactgggataattttgagatatattccaaagatcctcagagcatccccaacagcattgagccccagttccccagattagtaatctactcaataaatacctcttttttttttttttttcccgagatggagtctcactctgcaccctggctggagtgcagtggcacaatctcagctcactgcaacctccacctcccgagttcaagtgattctcctgcctcagcctcttgagtagctgggactacaggcatgcgccaccacacccaactaatttttgtatttttagtagagatggggtttcaccatttggccaggctggtctagaactcctgatctcaagtgatccgcccgccttggcctcccaaagtcctgggattacaggcatgagccaccacgcccagcccaataaagaactctggattgtttcttccttttcctctcctcctttcctgttccctacagtgtttcctaggatcacctcagtctgctgtatgggaaacccagactgagtcaccataacagacagaggcattgttactttaggactttagtggatatagttacatgggagagagagactgtgtatgtatatataacctttataatattaaaccatgctatactcaaattatttactggccaagatttccaatataaattggaaataaattggatataaatcaagaacagttaaaattggaaatagttaaaatacaaataaaatagctaaaattgggcaaaatacctgacccaatgctttaatatccgattgcataattaaacgagtaaagaggaaaggaaattattagcaactctatatttaaatgcaactgacatccaaggaagtcatgaagaaaactctttgtgttgataaactgaaggcctcttctagcagacttctgtgtttattgttctgttgctgactattttattccaaacaaatgaacttgcttgtcattataccccacccttccctagtacagggcccccattctttgaaacagtaactcattcagttccaaggagaatatgaaaagggagggtaatatataaaagaactgaaatgaaaagtggcctaagtgtggcacatttccattgtggattccatggcaatggagaattgatggcagagcatggtgagagatgtgaagcatcaattggctgtatctccagggaattcctgaagttcagttgccaccctggagggtggcaaatgctctctctcaccttccttgagttattgcttagatgactcaaaacaaaaaactgatgagctataaatgggctgtattatttgtttttacctgctgagtagttcagatatttcaaaataatctcaaacttaacctatggtgtggtttctgtgttaaacaaaataccgtaacttttagttgaaaatactgtgtaagcccacacaatctcttgttcacagataatcttgttgtcaaacattcatgatgacaaaaactcataaacgattcttttaaatatcaagaataacttatgctgtaagtcataatttcataagcatgaatttatgaatgtgttttgtgtttgcaattttcatttaggttgtcttaaaatcatgcgttttagcttaacttaggagaaatatatcttttgtgacaacataggatattcagagaaacgtgaaaactaggtgatgtgttttatgaaagaaggcataaagtatatcaagcataagaactttgaattctatttgtgttttttgtggctttagaaaagattgttctgggaatagagaattccatttgggaaacctagcacatacacagtagcagagttaaaatactgacttggagggttcatttgaagaattctatagaatttttgcatgttgggaataggtttatattcttaaacattgcactcagggtttctattcaaagcaaaaataactttgcatagaccttggccattctttcacattctaaagtaatccatttttttttttcagggtagttgttctcagtcctgattttctgataattcagatcatctttaatttacaccaaaaacttttagaagagtcagataataatttaacataaaatgtaaatgactgaaatatacattttttaaaggagcagatatggaggggtccaatgtacttaactatttgctctctttgtctccttgcattcacgggaatgtttctatgtagttttctaatttcacacaatttcaataatccataccctcctcatttttatgggccttcatgatactaaaaatgttaccagaaattattttgtgttagtctctttgtttagcacattcatacataagttttaacatttaactggcatatttttaaagtaatacatgttttttttttaaaaaaaatcagttatgtttgtgtgtgtgcatattttcttttgtggccaaatgttgcacgccctagtccttctatttaaacaatgagtttacataacaaatgttacatgataaacatgaagacatttagtttgaaaaaaaatgattttctagtttactcatttaaaaaaagctgaagtaaccgggaagaggagtggcagaacatattagtctttttcataatgccatcattaaacaaagatacttaatttccaggcctggtgcagtggcgcagcctgtaatcccagtactttgggaggctgaggagggcagatcacttgaggtcaggagttcgagaccagctttgccaatatggtgaaaccctgtctcaaaaaaaaaaaaaaaagaaaaagaaaaagctacataatttccaaaatgacttcagtgggacctgaggtgagggaataaaggctctggagtaatttcactctctattcctctcctaattttttttctgttcctttataacaacattttcactacttttgagcttgggagttgaggaatcatgaccagaagaaaaggaaagacgggaaagatgttcaagggtgaggatgcttaagaatgacctggcaagcttatgaaaatgcagttgtctggatcccaccacagagattctgatttagcaggtctgtggcaaggcctgcgattctgcattgctaaccagctcccaggtgatgacactcatgctggcaacctatgaaccattgagtggcactgttccagggggcagggcaatgagaaattgaagtcaaaagccccaagacctggtgctacgaaaatactctggttccttccctctcaactgatttacttgtcggtgtgattttgcaaaaatccctgaacttcttaaatcccagttacctcacctgaaaagtatgagtgttgctccagatctggaggctttcagaccatgcaaatcgaattcaaaccatgcaaaccattcaagtcattctagaaagttctgcaaggtgcctcagaggccaaagggagagatgggaagagggattgaatgggctctttccaaggttccctaacccacttgaatactttcatcttttatctctttcatatattccacttttgagtatggtttcatttagaaaataggattttataccaacagatttaaagaaaaactccaagtctgaaaatgactcatttatttaaaactgtatagaacaaagacatttagtgcacaattccaaaaattctctgatccttccacagcatgcccagtatgctgcaagagtgccagcaaacacatgcttactgctcacaaatgtgaaatttaaccccatgcactaggaggtccctagtgtggggtggttttagctaaccagactaagagagtacagggcaacatcgagcctttctctgcggtcatgtctgattcattaaaaatccagctttccccgaagatatattaattaccttctgtttcagaatttgtttttagagcctaattcttaattatatctccagccattgtgtgatttgaccattttggaactaaaaagttatcctatgaaattccacctccaactattgccacactgttagtttgtctatttcatacaccatgccaatcttagcgtggtgctagcatttcattataaccagctttcatttttaataagaccatgtgtatatgaaattgtagacttcagtctttgtatgaattgaaagctattaatcttcccagggttaggttatgttaaacagattgtaatgttcttctttttattatgttatttaaatccccttcatttcatactgcaccaatacatttctactatcttggaataaattaattccagttacgtgatggaaaattttagtgtaaaaatataacctgcagtataattttttctgtcagaataccaactagaactggtatgtttcattctaattggaaatttgagttatcgctttgatttttaacagtgggaaaggaaaatgaagattgatatctttcaatagccgttcattcattcttcattccttcattcattcacgtattaagaatagtctatgtgctaagaacagaaagagtgttagagatatgaagattaataagaccagatccctgcctgcaggcatttcctattctatgtcatagatagggggctattctgtttagaggtaaagcatgacccacattgcctctgacaagaagcataatgtctgtagcagctaactgctggagacaggaggctagagggctgccctggtaattggtattcaagtcttcaagaaaggaaaccagctattccaaaatcagtgggcaagaggaagttgtaaagttaagtgaaatgactaaaatatgaataactaaaggttggaatctggtagaaggagaggagagcatcggtcagcaccttagtttgggaaggtggtgtggccatagtaggctttatttagaaagaagcaattcttaggtaccagctaggtttcagttccttaaggggagaaaactggcaaaatataggcaggtttccagggtgcaaagccacgttctagcttcagctcaggcaaggccctggggtatgaatcaccaccagagtagcccagccaaaatgactaagggatctaagctggttgctaatgaaagaggttgcagctcaaggcagctctgctgacgcccactggatactgggattacattgatttaacacatggaaaccacttaatatggtatgtggcacaacacaattaagtactcataaatatttgcagataatgctgctgccattgctgtttttgtcgttagaagactcgggaaaatcatctaatacaggaatccatctgttggcggggcttgggcttctaatatttgactggttgatttttgtcgacccaatcttaacaatattatacacagccattacttcaggaaaggcagttgtaaagaatggtataaatttcctgtaacttgactgccacattctagctgagtcacctctatatacctcagtttctttgtatccgcagtgaagattaatgacctcatagggttgttattagaatgaagtgaattactacactggacttatttaggacagtaactcgcacatagtgagtgctcaaggaaatctcagaccctgcctgctagtggagggtccagctcctgatacatttgggggcaggtttaaggagttcattgatttagagctgtaagggctgatctttcaccctgcatgtcttcagcaactgtggctggtaaagtccagagcagtcaaaggctgacaaatccttgttagaaatcacaaatgcccattctcacaacttctgtggtgttttccatcctttccctagaatactttctttttaaggcaaaggaaagaataatcactgcagatagcacacagtatttttttgcaacatattttcaaaaattatgatgagaaaagtgtatcattcctgtgaagaaacagcataaggaaaatgatttgagaaagaaacatggttcttaaactgaaacaagtgtcagaaggaatcccagaaggcagaaggaaatatagtaatcatgatgaagtctagagctcacaccggttaacagaatggcagcagcgatattcatctcacgcctcttccatgctgtccctgagtgagcttctgctgaattgcctggctggtgaggattggtttcagcagcagaaggaatgggctgccagctgaaggctctggttctgatcctgggtagggtcagagaaagcaagatgtgaccatcacttttgaccttggtcttgaatttgattccatggaacaacgatattttacaaacccagttgaaggtttatccctttttctattcaacacagggagagtccttagagccccaggaagacttagccctttttcattctaagagtaaaccacatctaggtttccagagatgaaaagaccaggctctgatcttccttctggaagcccttgcctattcaacaagcatgagtattaaatgctattgccttggaatcataattcagttttcacagtttgggctatgtcagaaccattcttgtcaaccccctgttttctgagaacccgaaacctgcttgtttagaattttagaatctacttgactcttacaggggagaaaagatctcttttctcacccatcgctaggttcatggctgaggcacctataatgaaggacaaatcaacaacataaaagcatgcgaatttatttaatataagtttcacatgacacaggagccttcagaaatgacccaaagaatcagggaaaagtgtgtatttttatgctctgatttgaggaaaagtagatgtccagtatgactggacaaaggggaatggtaataaactggggtgaccacagcaaggcctgtttctgcagaacctcctgtgtccctgtgttttcagaggtaaaaattttcctttccttccagtatagtaagggcacctctggtatgatagtctcatgacctgcttcaggggagaagggggaaggggaaggtgagagtgaccatcctgcttctgctgtcttctcaaataccaagctgccatattgtggattttggagtagcgtaacttgaatccttttttttttttttttttgagacggagtctcaccctgtaacccaggctggagtgcaatggcacaatctcggctcactacaacctccacctcccaagttcaagtgattctcctgcctcagcctcccgagtaactgggattacaggcacatgccaccatgcctggcaaattttttgtatctttagtagagatggggtttcaccatgttagccggactggtcttgaactcctgacctcgtggtccgcccacttcggcctcccaaagtgctgagccaccgcacccagccgcatagcttgaatcttatcaataccttaaccaaatgactctgacagttttcctcttcttatctaaattcttgagggtcacccacacttcccaatgtcttttgaaacttgacctcttttctgctgaattgaggaagatacctgatttctttaacctcaccaaattcctacttcttactgttgttcattgctggctgaaaatttactttggcgagttcaccaagaacatacttatcggttcactgtttatatttgcactcaagataacacttgaggccctgctactcaaagaatttagtgacaactttcttcatcactctcatatcttatctgtcatcaagtctttttttcctcgtaaaaatgcttttagctctttaagtatgtttcatatctataatagctaagataggctaacagctataatatattaaacatccaccaaatggactattaaaatgacttaaacaaaatagaaatgtatttctttctcatgtaaacagtctaaggtgaattcatgttagttggtgttggatgtgtgtgtgggaagggaggggtgacacccacataattattcaagaatacaggccaggccaggtgcagtggctcacacctgtaatcccagcactttgggaggccaaggtgggcggatcacctgaggtcaggagctcgagaccatcctggccaacatgatgaaaccccatctctactaaaaatacaaaaaatagctaggagtggtggtgggcacctgtaatcccagctacttgggaggctgaagcaggagaatcacttgaagccgggaggcggaggttgcagtgagacaagatcatgccactgcactccagcctggcgacagagcaagactctatctaaaaaaaataaaataaaataaaaataaaaaataaaaaataaattaaaaaaaaaacaggccagcaagggtcttccatctgcaatagccaattgccgaggttgccctcctgaagatattcagccagcccaaaggggaatgagctagaggactgcacacggaggcgtcccatgtcctttgactcaaccttctactggctagaactctgccctgtggccacatgtaacagcagaggggctggaaaatgaagtctagctagatacctaaaaagaagcagagaaaggtttcaagagcatttagcaaccatatccaccttattcatgccctgccctctattcgcagtggccccgcagcactgctcaactagcttgctgcattggcctcttatctcttatctattgccttagatccatctaaatgctctgctactcttatgcctggaatatgttttcaagatgtgactaatcctctcacagcttgaaggataaaaggtcaaactgctctggtgaatgcatgatgcctggtcacctctgtagccccatcttccctgacactttcacagacagtattccctttactccaacctgtgggagtattttctaattcacaataatagcaggaaatacaatgtggaccagacacagttctgagcagtatattaactcatgcatttcttacgataactttataaggttgacagtagtagtatccctatttcacagagaaggaaagagatacagataagtaatttacatatgatctcacagatagtaagtggtacagcttgagtgcatatgactcaaagggtagaggttctagattcttaatcactgtattgtactacttctcccaatgttatcgtacatgccattccgtcttcctggaatacccttcgtctttcttcatctaacttccactcaaactttaaggatcaatttaagcatgccttattttaggtagccatggttgacatcagcctaatttaattgctactcatctatgtccccatagcgtcctttgcattcctctatatctctctgctatagcagtaaatgtaccaccattccgtaaaatccttaagggaatgtttagttttatgttcccaatgccagcacaatgtccagaacagtgttgtcccatagaaatgagagccacctatgtaatcttaagtattctagtagccacgttctttaaaagtagaagtgaaactaatattttattgaccctgatatatccaacatattattatttcaatatgtaatcaataaaaagtattaataaaatttgctttttccattctaagtctttgaaatctggcatgtgtctttcaattgcatcccatctcaatttggacaccgtattttcattgaaaatatttggtctcacctgcacacgtatgtttattgcggcactatttacagtagcaaagacttggaaccaacccaaatgtccatcaatgatagaccggattaagaaaatgtggcacatatatatcatggaatactatgcagccataaagaggatgagttcaagtcctttgtagggacgtggatgaagctggaaaccatcattctgagcaaactatcacaaggacagaaaaccaaacaccacatgttcttactcacaggcgggaattgagcaatgagaacacttggacacagggtggggaacatcacacaccagggcctgtcgtggggtggggggaggggggagggatagcgttaggagatatacctaatgtaaatgacgagttaatgggtgcagcacaccaacatggcacatgtatacatatgtaacaaacccgcacgttgtgcacatgtgccctagaacttaaagtataataaaaaaaaaagaaaatatttggtctctatttacatttcataaactttatagttgaaaaaagaagattcacattcctaagttgttccaaacatacacaaaagtttttcaataactgaaccaagagtcaatttttaaatttatatttaaatttaataaaatggaataaaaatttgttaaacttcagtctctccgtctcactagcctgatttcaattgctcggtagctacctacagccagtggctcctgtgttagacagagcagcacagccctagaacacagtagatcctaaatcgatgtttattgaagaaattaatcaatgacagtgtagaaaatttgcagtgattatgtcagaatcaatagttctccacccattttctcccacactctcaaaagggccaagttttatatcaccaaatgatattcctcttacttctttctgagcagaaacagttttggaaattaagatctttttcaaattttccagactcggcattttagcagcgtttctatttgtaccaacaatgcctttctacctattttccttgcttcttaataagttaactttgtgcgaaggtcattttgtaggtcagtgtaatattgtgcattaagggcttctaagttttctggtattataagaactccttggtttccttctacttttcagaatggaaaatcctcagagcaattttcatctaaaagtgctgcatttaggttgtttcacaattccccaaccctgagtcaaatataggttggtgtatgagcagcagtgtctcttggctaatcaagagcgtctccttttgctacgctcagtgttagagaaatggagaaagtcagctgggtttagagattaggtgagagactcaggcatatcctttgataagtcataaatcatttcctgtttagaaaagcacatgtttagacacccataaaatctccaaatgaagggtgttttacttttccttcaaaatctcactgggaaaaggtacttctgactttccaagtgaataaaaataatgactcctgattaccatgtatgtttaaactgatttgcaaagcaagtgaaaaagagtctagtgagtagtgataagcatcttttagacatcagaagatgtactgatttaaaggtccgtatcattttataactagtatctattgagattcaaatggttattactctgtgtgaatctgtcttttctaattgtttttacttattttagaatatcgatttgtgaatattaaattcctaagttttccagcaatccagtgtttgttttggatatccagcctggatgcagaatagctgcagaaagttatcacaaattgatctctatattctgtttccgagtggcaattgtcaaaaatttggggtcatcggctacccctcccacccctaagaagttccttgtacttcctctttcaaaacactcacatcattgttcagtgcctcacttctctactaaaatgtaaccaaccacaaagatagggactatgtctttcctgtttactggtggattctcagtatctagcaccatgaccaatgttaatagacgttgaatcaattccagttgttacctcttcacactgggacaaaagtccttgcaagtattctgctgccatttgtatagattcaagccaaatatgtctcaaaacgatattacagatgatctcttcgttgttcctctgacaatttctttcccccctgcattgcttaacttgattgacaatgacccctactacttataacatgtgccttttaggtagtgcacttggcactacattttatgtgatagttttatgatgctaaagactatttgctgtgatgatgctgtgttctcacatggcatatccagatttatttatgctggtgaccaaaggcaggtagttaaccttgaaaataggttaaaatttgaaaggcagcaaatcttagggctagaatttataatttatctttaaggaatcttgaaaccaggtgtgaaggaagggacgtaggctagaagtacagaaacctgggttctgctccagcactgatgttaagagcaagttgcattgcttttctggaccttaattttctcttctggaaaatgaatagattaactggaacaaggaaggaaaatacgtgaatggcttccgtttctgtctcgtttacccctgaaagacatggctagtcagtcagctctgtatcagagcacttctcaaggcaatgctccaggtagctaccactcactaatgagagttagcacataggtaaaacctctttgtcatctctaggctacttcatgtttaagatactctccagctttaaaattctaataactctattagactgaaatttaagaatacgagaataatcatccctcaccatgaagagagagtctgaggaaaaaataatgagaacgaataacccttctcttttactacaattcaggactgccatgaagagccgtccagattgtgaaacatacaactcatgatgtgaatggtacttctttgtttttctcggtgtacaacttgcacagctgttcatggccctctgcttccacaaattcatttctaaatagctgtacctcagttctttgacttctagtatgtctaatttaatacacatttctagatttacgatatataagaaatatctccatgaaggaaaaatgtaatagcccatgcttttcattataatagaattttatgaaacaatgtcttttaaaaacagaaacatatgtactactacttcgcaggacattagcccttgtatataaatcaataatacaaaaaattcaaattaccaaggattagaaaagactgctgtgggatatcttctggtgcaagcatacagttatttatccatttctttcatgaatatttattgatgttccaaacattaggctagacactagagacacatcaataaataaaggaaataggtttgatctctatcttctttgatctgtagtttagtgggggaggaaggaaattaaacaagtaactactacaggttgaacatccctgatccaaaaacctgaaatccaaatgttccaaattccaaaactgtttgaatgctgacatgacatcacaaatggaaaactccacttctgacctcatgtgacaagtcacagtgaaaatgcaggcacaccacatagagtttattcagcatccccaagggaagaaagatcctctcagcccccgttagctgtgatatatcttttccacccacacccagattccatcatacaagcaaacccacaaaaggtacgaaaaatggcacatgtgcgggctagacgcgacaacggcaggtaccctacaatgtccagcatggggccaaaacctacgtgcattaatcactgtgtttgctggtatattctctggtggtgtcaagatattgttgaaaatgccctaaaggcctgcatgatatccatagggtaatgcaaatattccaaaacctgaaatttgaaatactttcagtcgcaagtattttggatatgagatattcaacctatagatggtaagggtattactatgatagtgctacgggtgtacatcaaggtaattgaccctggcttggcaggatgcagaaggctttcccaaggaagccttacctcagctgagacctgaagagaagcaggagttagacaggtcaagttggggatttggaggaggtggagtcccagcagatggaatactatgcataaaggcctggaagtgagaaagtcatgtcatgttatttcaagggactagaggaagcttagcaaactggaggcaagaagatagcttcagcacactattgaaattgtccaggtgagtaatgatgatagtgtaactaagttgtgatacctaggtatgtgagctgaacctatggagaaatgttctaggctagagaatctttaattggatatttaattatcagtatatacgtaattaaaaccttgcaagggtttgaaatggttcagagtaaagttcgtagatgagaagagggcctaggagtgaacccaggaaaatggcaaagtttcaggggtaaataaagaaaaataagctttcagtggagacagggaaatttgcagttcagtagataggagacagactaggttcgtgtgatgtcacagaatccaagggaagagaggttttcaagaaaaagtaacatttagaggtgtcaaatactacaaaagcatcatgaaagataagaccaaaatatatcctattaatttagcaacaaggaaggtattgacaacctttatgcaagtgatttcagtgttgattatggagaactcagtaattacttggtggtaactaaagaaccaagattgcagtacgttcaggcatgattgagaattgagaaagtgggggagcaagtgtaaaacaattattttaagacttttggctgcgatgggaagagagaaagggccatagtagcagaagatggatgtaggggcaggaagaacacactcttaaaagggtagtgacttacacatgtttaaatggcaatgagaagaagatggtagagagggagaggttgaggatgcaggagaaattagagataatcaatagcacaggtacttgagaaggcagaaagatgaaatttagaaattagcttcagataggaaggaaagtacagcttctattacaacatcaggggagaagggaaggaggatgggcatagctactggtagttttgtaagtttggtgaaaggttaagtaggattgttgtattggatttattttttattgaagtggaagctgcagctaaatgcccagtgatgaggaaggtgttggagtctgagatttaaggtgagtggcaatttgaaatagctgctctaggatcctatttaacagagaaaatgttgagtacacaatcagtgagcagttttaagtccactctattctgtttgcagtttcaagtacctttcattgcttctaagtttatgaaaactggttcacaatcttcttgtgcttcttatttctacctcttttccttctgttttctcacctccccagtttaaacagtcccgaattttttacaattaaatatacagcaactgccatgaaatctactgataaaagatactgcaaaatcagtttgggattgggttcattagcttacttattattatcaatcctaggccactaagcaaccttgcataaaatgcataaaatgaggagattctagtggaggatagttttcaattatctcattaatttcaggccatgtgactagtccaaatagatattataggccaagaagagcctatcttgagattttaactcccaggataggttttctacctgatcaaaagaatctaataactattcaatctcttcttaaatggtttggttttctgtgcaaacagttttacccttttagctgattttctaggtgttaaattaagaaaattctctcagatacttgttcatcatgtactaggatccctgatgtgttcagagttgtccaactttcaaagggctttgcattcagagtacctaatctaaaccctgatatcattcttttataacagaaaaccccggattagactgggacagtgtctgtcatgttcatcactgcatctccctcagtatttgtagaatgaatgaagggacaatggcaaactatagtcctaccatcacacttttggtagtgaggagaactgctgtaacttggaagattggagggggaaaaggtggctaaaacaatcatacagtaaactgggctgctatcaagagaaaccatttgtcaattttggcttttgttgccattgcttttggtgttttggacatgaagtccttgcccacgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatattcttccatttgtttgtgtcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgattttagtacattgattttgtatcctgagactttgctgaagttgcttatcagcttaaggagattttgggctgagacgatggggttttctagataaacaatcatgtcgtctgcaaacagggacaatttgacttcctcttttcctaattgaataccctttatttccttctcctgcctgattgccctggccagaacttccaacactatgttgaataggagtggtgagagagggcatccctgtcttgtgccagtttttaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggagttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaaatattgattattgccacaatttcagagcctgttattggtctattcagagattcaacttcttcctggtttagtcttgggagagtgtatgtgtcgaggaatgtatccatttcttctagattttctagtttatttgcatagaggtgtttgtagtattctctgatggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtaggcatttagtgctataaatttccctctacacactgctttgaatgcgtcccagagattctggtatgtggtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaagtatgtggtcaattttggaataggtgtggtgtggtgctgaaaaaaatgtatattctgttgatttggggtggagagttctgtagatgtctattaggtctccttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcataaatatttaggatagttagctcctcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacgtgagatgggtttcctgaatacagcacactgatgggtcttgactctttatccaacttgccagtctgtgtcttttaattgcagaatttagtccatttatatttaaagttaatattgttatgtgtgaatttgatcctgtcattatgatgttagctggtgattttgctcattagttgatgcagtttcttcctagtctcgatggtctttacattttggcatgattttgcagcggctggtaccggttgttcctttccatgtttagcgcttccttcaggagctcttttagggcaggcctggtggtgacaaaatctctcagcatttgcttgtctataaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgggctttcctttgagggtaactcgacctttctctctggctgcccttaacattttttccttcatttcaacttggtgaatctgacaattatgtgtcttggagttgctcttctcgaggagtatctttgtggcgttctctgtatttcctgaatctgaacgttggcctgccttactagattggggaagttctcctggataatatcctgcagagtgttttccaacttggttccattctccacatcactttcaggtacaccaatcagacgtagatttggtcttttcacatagtcccatatttcttggaggctttgctcatttctttttattcttttttctctaaacttcccttctcgcttcatttcattcatttcatcttccattgctgataccctttcttccagttgatcgcatcggctcctgaggcttctgcattcttcacgtagttctcgagccttggttttcagctccatcagctcctttaagcacttctctgtattcgttattctagttatacattcttctaaatttttttcaaagtttttcaaaagcaatggcaacaaaagccaaaattgacaaatgggatctaattaaactcaagagcttctgcacagcaaaagaaactaccatcagagtgaacaggcaacctacaacatgggagaaaatttccgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaagaaatgctcatcatcactggccatcagagaaatgcaaatcaaaaccactatgagatatcatctcacaccagttagaatggcaatcattaaaaagtcaggaaacaacaggtgctggagaggatgtggagaaataggaacactcttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcactattcacaatagcaaagacttggaaccaacccaaatgtccaacaatgatagactggattaagaaaatgtggcacatatccaccatggaatactatgcagccataaaaaatgatgagttcatgtccgttgtagggacatggatgaaattggaaaccatcattctcagtaaactatcgcaagaacaaaaaaccaaacaccgcatattctcactcataggtgggaattgaacaatgagatcacatggacacaggaaggggaatatcacactctggggactgtggtggggtcgggggaggggggagggatagcattgggagatatacctaatgctagatgacacgttagtgggtgcagcgcaccagcatggcacatgtatacatatgtaactaacctgcacaatgtgcacatgtaccctaaaacttagagtataataaaaaaaaaaaaaaaattaaaaaaaaaaaaaaaaaaaaaagagaaaccagtgctctattatctaggtatataccaaggttacccactgcttgactctcattattagccttctttgatgttctctggtacttgatgtctttcataactaatcaatgtattaatgtatccaatcatttactcgataactttattgaaagcaaaagcagttgcataccagctatcaagctggaagtgggagatacagccgcagacaaggcagatatggtcccagcccttaggagctcccagagtagcaggaggtttccccttccagtgtcttctctctgcttttcttcaaaaggaaaaggctgatgtgtataatataccatatctctttgaagttctctgattatggattttaggtttaaaccagttcttcatccatgactttataaattgaaaatccaggattttgctgtgttgttgtgttcttgttttgttttgatgtccctgttttctctagatacagttagaaatgtctaggaagaaatttttggttagtatgggagccccacaaagccatttttttaaacataaaatctgtattacatatcaggtatgaaatacagggggaatgaatcatttctccgtaaaggaaaatttaaagtaaatttcaggaaagtgaattctttcccgtttgcattaccgacagatgcagaaactttaatcgtcatttgctaagagggatatggcagataatacacaatagatgtcgtagcaacattcactcgcattctttttttttttttttaaagaaatctttctttcaagaagctattctaggatctttctcatgacagtgtcctagttcttatctttgctacacacaggctcacaaagtgttttctttgaagggcattttgttattggccctcttttcatttttcttttccgtagcaaacagaaccgaaggtgtttactccccacggtgagagggcacctgggtgcacaaacagtggtgtgaaccactggcctttctctgctttccgttccctgaatgtaagaaacaggtgcagtgatcaattcactgcgtgcagtgaaccccaggcagaaagagaacgtcgtgtcacagaccttttgttacttggagagaatgagcgggaagaaaggctgcctctgctgctactgagacccttttgcccattttattgactgctataggttcatctatcctaatttgtctccggctgtcccagtttatccctgttattcttgtgttactttactttactatattttattttattttattttatttattttagagacagagtcttgctctgtcacccaggctggagtggagtggcatgatcatagctcactgcagcctcaaactcctgagctcaagcaatcctcctccttcagcctactgagtagccaggattatagctgtgcaccactatgcccacctaattttttttttttttgaaatggagtctcgctctgtcacccaagctgcagtgcagtggtgcgatctcggctcactgcaacctccacctcccgggttcaagcgattctcctgcctcagcctcctgagtagctgggattacaggtgcccaccaccatgccctgctaatttttgtatttttagtagagacagagtttcgccatgttggccaggctgttctcaaactcctttaactgtttttttatttttatttttaatttttaaaacatattgtagagataagagtcatgctacattgcccaggctgatctcaaactcctggcttcaagcaatactcctacctcggcctcccaaagcacctggattacaggcatgagccagtgtgcctgaccctgtgtgattattattagcatcctggacactctcaaaagtgttcaggtttggacaatgaactataggatcaccctaattacatgagattaagagtagagaccttgaccaccagaaatggtcaatactcaccatatattttcttcctgatgttagaacctggtacttttgggaaatgaaattgtacatgagatatatgcagaatgggcgaagggagcgaaaagatttaaaaaattaagctcgatttattgagcgcctcgagtgcgctcagtgctgttccaagtgctgacagcagagaggtaagttctgttctccagtgttcacctcacacgtgcaagccaggtttgaaaacacactgtctttccttagtatccctccacccctccatgtgactatacgtatgtatcaagtttgtgatatttcacttctgggcttcttttcatttggaaatttaatgtcagtgtatcatgttttaattaataggacatcatgttatgaaactgttgaatcgaatattttccctaggcatcaaattacttgtcagtggaaatttgacatctagatatgagggacaaaagagatgagaaaaataatagtaaagtgttcctaaaggatgctggtatactgtttaggtattttaatgcactgttacaacctaaagtgtcttgtaaagtatgttctttagaaataaaataaataaaacaagacatctctccataggtacaaatccacttgccttcctcaattcctatccttctgtgatgggaaatctctgctgtgacaaagaaccatgttaagaaaaccataaagttgtattgtttgtagatttttttaatgactaaaggaagatattgcaagtagtagaaacaaatagaggaggtggccctgaaggtcaatataacggagttcactgcagaaaagagaaactactctaggtacgttagacacatatcaaagttttggaaaggctaaagtagcaggttttagacttggcttcgaggacagatttctaaaactatatagaactgatccaataagaaactaccatctccggggtaccactgaagcaatgatttcaagaacatactttgtaaataggaactaggaaccaggaggttgaaatctagacgctaccacttttgaagctgctgttagcaactgcccttctccagccaggaagctggagaaagaactttggaactctgatgtaggaaatctcatgtttctttgactaagctcgccaacagaaatagccaaaaggggcagaaaggtgacctatgcctcacttccactttccagatctctcacaagtatacacatttggcaaaacgttgccagatttagcaaataaaaataatgcatgcaacatacttaacactaaataaaaaaagattgtgtagaaaatttaaatttaactgggtgccttgtattttatctgacaaccctaacttattatatcctaattcataatcagaacactagctgcatggaagtctggcaaatacagtttttaatttccaacctgtccaactggaaggatggtaagtagatttaggtgagccagttcacagtattaaccaaagtagattgcctaccaagaatagctaaagcctttctgcccccagacgcttatgctaccatctgaatatttttactttgcattcttatattcttggaaatcctatcaatctgtgattcagattggtttggtttaactcagcttccccttttttttggagacagggtcataccctgtcacccaggctggagtgcagtggcacaatcatggctcactgcaacttcgacatccctgggctcaggtgatcctccctcccacctcagcctcccaagtggctgggactacaggcacgtgccaccacaccccgctactttttgtattttctgtagaaacagagtttcgccacattgcctaagctggtctcagattcctgggctgaagtgatccacccaccttggcctgacaacgtgctggaattacagatgtgagccaccatgcccagcccctctttttaaaatataaaaatctcccagaatgtgaaagttgtcagtctatactttgggaataagattttcaacagatagaagagaatgaggattaaaacataaggaagtttgggagtagaaaatatgggcaccagaaggtggaaggagagagcagatgcccatttatatatctcctttgttgggtgttggacaaatccaggtcttaaaataggaagtatttcttttccgtacttcttgaatctttcatatcccaaaagatgcatatttcccaaatcatataacccaaagtcatgctatcaaaatgatataaatcatccatggtataggttaaatagctatatatgtatatgctggtctgagacatgtatatgactattgtgtccatggaaatttgagtttggggttctggaccatttatttgcaagtgatttttggttagagaactctttgtaagttggggattgcttttacttattttatgagtaaagatgtcaaaaggatgactgctaaatttgcactgtgttaattcactatttagtgagaagaaatattagactagctatgaaaagtaaaactgcctctccaaaaagtcaaagctgatgaaaaacagtcatacaagcacaatgccgctcttcggaaacatggaaacactttttccttcccaattttccctcagattttctcttccgcatttaaaacacttgggtggttcaagtttctaggctaccactgattgtaacagcaaacagtagcaactggaagcagtgggatgttgggagaagtaatagaggtagctgctacccaagttatcctggaggattttccatggcaatgaaatcaggtagtagaagcttggctaactgagtgtaagcaaacagttctactgagaatggtgttgtcttttcaatccgtttatctgtgatggtgatagtgtgaaacaggggaattttatccaaggtttaaggaaggttatttggttaaaagaggatattgttacagtgaagtcaaactttccattaactttttgctgtaacaacagattgaacgtagcatttcaccgtcaacgagtaaagtgaaatttacagattaacttatgtgcctcttttaaaatatatcagatttctaaattgcttttatttcagaggtatgggaggttcactttctctttgaaagtgtacattatttttctagtgtcttacatctgcctacaaagatgttattttacttgaaagcacagtaactatttgatgagaatttgtcagcatcagtaaattaaagaccctcaaatgatttctactaattatagtttaattccgtacatttaatgatattttaaaacacatgagttatttcataactcccaacatcacaaggataaattttattctacaaacaaaatattgtgctaaatgaaatagttcatttaggcaaagaaaggagcacagaaaattagtggaactctctgctgtaagtaacgtagacattacatggcatattgagtctccatgaatattgtcatgttatgttttaaaaaggtgatcgaacatatggcatttaaaagttccaagtcctcttttaaatgcttcagaatctattatttaatgatcatcttggatctcaaaactgatcttttgaaagattttattcgccccatgtgttaatatgatttccctgtcatatgatatgattatctatcaatacttaaaaccagcagccaagtaaaaaatcagttcatatcatttaatgaatactatgagtcaggatctgggtaggcaagctattttcgggtttgagtagttccaaagcttaaaaatcttatattgattttacagtgaagaagaaatagtcttagctactttggaggtttcaaacattgactactcaaggagtatttccttgctttctcaggcaccaggcagtttttcaggagcaagcattcatccattcagggaattgtaacctgtagtttccacttttctagcaatcacacttaaaaccatgagagtaggccataggacataaggagctcagcttctcagggcaagcacatcctttcagctttcacctgtccgtttgttagtgttcacttccgtgctcaaggagtttcttgttgcctctgagttctaagagacagaacgaagggagaagggtgcagaagtctaacgcatgttcatggacttatctctccaataaagagcttgttttatcttcttttatttatttattttttctaatgaagccattagcctcaaacaaagccatggaatcttatcagagtgaaaccggggtcattccataggctggctgagtgagagctccatggcacgatgatgtatggtcactgcacaacaacgcctttgccacaacacatgtgccttttaattacactttaaatctcatttgaagagatgttatcattatggaaattgctctgtaaatgtgcccaggatgagacccaataaaagtttgctgagaagaattgaagacagaggagatgaatcagcagctaaaacattaccatcagacagaattttcttggctgtaggcaaaacagcccatgcaataacagaaaatcttcattgactcagaggcgtattttccctagattattatggggcactcctgcctgtagcactatcacttctttgataagctgaaggaagcgttctgctctccagctcagcgggcctttttctccccaacctcagagccatcatttgaatttatagttgccaaaatgaataatacagtattgcccttgtgttcctgacttcatgcatgcatgcagagcggggttaaggttctttaaatgaaagattgccttctattcatgcaataaagaacacctctgcttcctttccagggtcatttaaaaataactataccgctgggctatggaaagcacataagaaagattcttagggtaaagtcaaaatgctcttttctctacaacaggcattgtctcatatctttgtgtagcacagctgatttgaagttttcttttaagcacattcttaattatcttttcctttgatcttgaactgtttccctgggctaccagacagagagcctagagccctacctccgctttccccgaggtgcaaactgctccgtccttccacaggcaggcccctggctgaatgcacccttttctccatggttacccacccacctctctgttatttgttacttcccaagtgaatggcaggttaaaatgggaaaaggtcaggttatctgaatgtggttagagtgaaatgaatttcctcattgcacccaagaactgtcctttgacaggtctccttccccaaatcgggtcattttgtacgtaggctcactgggagtaattctaagacaactaaataagtaaaatcacattttggtgccattttccaatgtattcttcttcttgggggttctcctttaaaatggtactggaaggatacgttgtcttcattaatccattgtatgtcccgggggtggaggtggaggtggcagtagcagaagcccgtgaagtaataggtcgtattttgtgtttataaatatttctgcaggtttttgaggagaagatccatcattcttataaaggcattcatgacctccagaagattaagggctgttatgctagaacagtgtttcattcttaaaatggggtctctggactagcagtatcggcatcacttgggaacttctaagaaatgcaaattcttgagttctaccccagacatacagaatcatgatctctcagagtggagcccagcagcctgtgttttaatgagccctctgggtgattctcaagcccactcaagtttgagaaccactgtactaagggaactactgatgcatgatgcaagttcacgctcacaggcacgtgtgaatgacacaaagaacacagacgcctgagagagcaagaaagacaacatagactgtctgactccctgctgggcccttctttaccgcccctatttcaggctaccatgcccatgagtggatgacacgtaccccccgacaaaggtcaacaccactctcccttccacaccctatcactaagtgacaggctaagcctatgttaaactgctcacatctccttggaaattcaacactttaataataggtagcattatcacccccatcttcttctctaagccagaaacccaacttgcctccctatatgttatccttgcattcagtcagtctctaagttgtattcatgatctctcaaaaatatctccctttttctcatcctgtgtctattacctcagtttagatctccatattctcttgcctctaatgttcttgcctctaatgtaccttttcactgccaccaagatgatgttaccaaaaaatcttaaacagattagacatcttcacaggataaagtccaaacccttagcttgatacacaagccccttcacaatccaggccctccttcctgtgcagctatatatatatatatatatatatagagagagagagagagagagagagagagagagagagagaaattttgatcttaccactctgtctctcttcccgccatgggtcttcccctcttccctccggagttacttagctctgatgtgtattcttatctcgtcttatcttcaacttcattcatgtttttcccactgcttcaaatttcactctcccacttctcccctggccagctgctactcatccctcaagaccctgatcaaatatcatcacttgtatgatggcatctgcaaatcttggggggcaaggctaattgttctttgttcccacagggctgtgttccagtttaacatgatcacatgttattttggttcatttatttgcttaagactttttcagaaggctatgggctctttaaaatagagaacttacatcttgtagttttaagagtatttttagtaaaagtttagagtgacccccatctttctgccagcccacaaaaggaaaacatcaaaaagtgaatgtgtaaaaggaagagaactctgacaaaaccaggcagaaaggtttttcagcaagtctttttattttctgttcaggataacattaataattatccacgttggtttctcattctcctgttggtgaatatttttctgctaaatttaaaaccgtatcacaaactcaagcagagatttacaacatttcaacagcttttctacccctgccttagaagggtggatcaaaaacatttgtccatggtaaagcactatggacatgacttagttaacaattctctgtttgggtcaccatgaggcttcttcgtttatactcagggtcagcgacaatgctgatatgcagctacaatttctcatttcttactcagggtgttatgaagcagatttccactgttctttaatcgttattaaaatgtagtccaggtgcagtggctcacgcctataatcccagcactttgggaagctgaggcaggtgggtcacataaggttaggagttcgacaccagcctggccaacatggtgaaaccctgtctctactaaaaataaaaaaactggccgggcatggtggcaggtgcctgtaatcccagctactcaggaggctgaggcaggagaatcgcttgaacccaggagggggacagaggttgcagtgagccgagatcacaccattgcactccagcctgggcgacaagagcaaaactctgtctcaaaaaaaaaaaaaagtcattctcatgtaaaaattcttgtaaaataatctgtaaagtcatcctcttatctgttctagttcttcataagacttatataacatgtcatatgggcatggaaaggcctaagccttcccaaaccttgctcttttggggatgattttccaaatgtacttgttctcagttgaaaagagcattgcggccgggcgcggtggctcaacgcctgtaatcccagcactttgggaggctgaggtgggcagatcacgaggtcaggagatcgagaccatcctggctaacatggtgacaccccgtatctacttaaaatacaaaaaattagccgggcgtggtggcgggcgcctgtagtcccagctacttgggaggctgaggcaggagaatggcgtgaacccgggaggtggagcttgcagtgagccgagatcgcgccactgcactccagcctgggcaacagagcaagactccgtctcaaaaaaaaagaagaagaaaagaacattgcatcatggcacaaggacacaaaaaataccctggacctgcttcagtgagatggtctaagggtctctagcatcttctgaactgaactgaatgctttgggaagaattaatagatacacgatgtatattagttcgtttcacactgctataaagaacttccctgagactggggtaatttatttaaagaaaaagaggtttagttgactcacagttctgtgtggctggggaggcctcaggaaacttataatcatggtggaaagcaaaggggaaggaagcaccttcacaaggcagcaggagagagagagaaagagtgaatgggaagagccccttataaaaccatcaaatctcatgagaactcactcactatcacatgggaaaacagcatgggggaagccacccccatgatccaatcacctcccaccaggttcccccggattacagttctagatgagatttgggtgaggacacaaagccaaaccatatcacaatggaaagctcatgaatgggttctaagaatgaggaaatgtaccttagcattttgcctacttttcctttatgacatttttttcccggcaaatatgccaaatattacctacctttacatcagtgtccacatgcatatcccctgtcttcctccttttcctcatacattaacaaaagagtaactttgttttctccccatcactgttcaccctattgtataagagaagaaaagcaaaataggatgaaagaactatctaggcacacacacaaaagtcacactctccagaagaaagaatttgctctacttggtagtagacagaaattaactcactgaagatcaccagagaatcagatccaattatatcagcaggactttagtttacatcatggtactagaaccttctttaacattcaaaacttatgaatacctagaaatagttttaaggttaatatctctatgctgtgggctaaagagtacccacaaatgaatacagttgtgtctgatgagtgtctgtgattattttggaaattgtcctgctatttaaaatgaaaaaaatagaaatgtcttagattttcctatcattaacctattgtaaacaattacatcagtgtagggttgttttgtggttgcgtgggagtattttgaggtttttagggggtaaagtgggggatagaatgaagttgttgtttgcatttacaaccctaataattaaaacaagccagagggaattacctacatggctgttgtgatttctagtgtatgatcaaaaataattatggcactttgccatatgttcttgctttcttcttagatatgtgttattgggaaaagatgagacttgacatcaactaattgcttttttctaatatacaaccttgaaccacagtgattctctggaggacaaaaaatagcttagtgacaaagagattccagaaataagagcttttcgagcttttaactctctatgtaatatagacaaattgcacagattaatataaccaaatatgtattggtccatgggaagagagttacctatttgaagaataggagtgtattgtgttcatttagaaccattcagaaacatcaatgatattagttctgagttgactaaggataaatttttaaaagcaatacctaattggaaaattattcagttgttgaccattcctatcagtgctctgaaactaaatatctcacagatgccttaatgagttattataattatgttgctgtgatacatgtagcccaagtcagaagtcacttgctttgtatttaatggatggggaagacactggagcttggagggaagagaataaaaataacctagtttcaggaagatctatgctctaaccctgcttctgccacataacaacaactctatgatttgtataagttactttacctctcaaactcgtggtttcctcgataggggataaagaaggcctatttcatagagttggtgtaaaggatttataagggctgtaagtattagttcctgccctgtttcatccccctaccctacccccacccctcatcatggctctgcaaaaacaaatatgtctcagagttggaaagacccatctggtctttctcagataagggtagttttcttcaaacagactgattcctgcacataaaatataatataaaaaaccaaaagtaccttcaacattgtagacttttcatatgtggttgtctctgtgacttaaatgtacaatctagggtttgcatgttaaggtctttcaagattactgttggcactgatctgaaagatgtctcatgcaggaaatgctcacccaattatgagcactgaggctgtatagcaatatcagaaataatattgcagcacagtattttctatggattttagatgcagtattaaaaaaagaaaactcagcctgtctttaagactcgttttctctttcaacaccagaattaaaaggcatgccattcttttttaaagtttatgtgcagagccaaatgaatatcaacattagttctccactgggtccacggcttctttttaaaaatatctgaagcagtgttactctacccactttttctcaggaaattgtgtcctttagaactggcacccatatagtttaggaatgcttgatagggtatattttaggtgggagtcacctgtgcctatatggagctttgatgtcaatgcccttgtcatttggtgtcaatggttttgtcattctaatttatttggccccaaggtgtgtgtgtgtgtgtgtgtgtgtgtgtgtgtgtgtgtgtgtgtgtttgaaacacagcatatgtatttttttcttactccttgagaaatagaactttaaataacatttctatctttaaaatgtacttgtgaatagttatcactttcctgaattctaccttccaaaggtaggacaagagaaggatggaattaaatcacacatgcagctatttttataacttatgagcactcaatgatggtagcatccctcttctttaccttctctctgattctgaagccactgctgttttggttcctgtatggctgggactgcctgtccactagacttcctgccttcactctgaccctgctacatttaccctgaacaccatcctcccaataatcattaccagatgctattttcacaatgttacacctttacacaagaagctacagtggaatattatccttacagaatcagataaaaatctccaggcggcattctaagctctcattggctacactgtaccctttgaacctgaacttcctgagaactacctcttagctcctgcctgtagctctggctcccatcttcatgcagtaggtattcgttttcttttgaacggcctcatatcttctctgctagcaggattggagtcatggcagaaagtgagagggggactagaaggatgcaacattaatgaaacctcacaataggttaggcattgggttaggtacttggttgatctactcacatcatctcatctaatctttgccaaaaccttaaaaggtaggtattatcggccctacttatagacatacaataggtacttaatgcacatttttgtgatgaataaatattcgggaatttttgcattgtgactggatgagaagaaactaggaaaaacaagacgtagatgagaaagatacctctcatcttacttccaacctaggagatcttaaatgaactcatcagttttaaaaggtaatcttaagaatggagtcagagggtcacacaaggagagaaagcatcacgtattaccagagttcgggattgcttaaggcggtttgacagtttcctccgggggtaatccaccctaggccaggcatttttaaagattagattttgaaatgaagctttgcacttgggaatatactgaggcaagaaagcatatcccttctccctgctgagagagcatatcccttctctctgctgttgcagtgcttaagtgtgagaattttcgaatgagatatgaaagcaaagacaacaaaccctgcaggataatagtctctgaggactttaataacagccgtttttaaagcaaagcctgtggactcctaaatccatagctgctcgtttaagatgcaacgcaatgcagtggacctgaaaacatactccttatctacctagagcaaccaggctccaagccaaacagcagtcctcaaattaactcttgtttctcttgggacgacaactctgctgcttttaaaggtgttgcgtggccacatatagaataagaagggaaaaaacagtcacaccctcttgtgagtctgtatccaactgcattttctgatctggttaggaacctccggtggttagattagaatcctgataaggccaagactgtgggtccaatttcttcctatggattcttctcgaaaaacttgttaggaaagatccacttcgggtttttttttttttttttttgcgcttgttttaattcccaatccataatagactgatacttttgtaacatgcaataaaaatgaattattttaaaaattacaaataccagacatacaaaatttaagccgatgctttttatttttagattgctgtacacgtttctaaagatttgctttcaatttctgttcttatgtcttcataatagaatatctgtttctgtgtgtgtatacgtatgagtgtatgcaagtgtgctccaaaagctctactatttagagctcatgtttaatgagtcatgttggataaccagtctaagggagttctactttcatataattgtttttgttttatttttatttaaatcattaacaccttttcaaaacaactgtatcaaataacagtcatttggtcatttgaagcatttacatacactgctttcttcttaaacagattttactgaatgtaaatctgctttccctggctaattcagcatcatcatcctgagcattaactattttgcttcgctataaaacgaggtgatgccttcaagggctactgatgcatggagagctgttagtttccacactgtgtgaccctggtcaattatgcatgcccatggctccttttacacctttctgattctctgtaaggtgtcacttcttcctactctcaatttagccacttaggataatttctttactattttgaattgtatgttcctgaccttctaagttcttagaaatcagaccactttttttcccatcaagctaatttaaattagataaaaattatcagtaaggaggaactaatggccttataattattcatatactaactgctttcagaaaagcttagagataatctgtctataataaaattcttaaggagatttggtcacttattgttattctttctacaccattgtgtttgtttccttacttctcagctatattaaaatggggaagttttcatttgctgagtcctattttagagaccaataattccatttacataggaaaggaaatatgtggatacgattattcatgatgttctagaatagtatcacaaccatctgcttaatggttaataaaatggttaataataaaaagaagggtacagcactaattcttgacatctcccttctttatttttcttctagtaaaacatccataacttttcctattcttccccagttgtattattacttatgaacaccatggatcattctactttttgaatgaaatagtacaaatttaatattcgataatcttgtctttgtacttttctttctaaacttttattctcggtggcttcctaaaggaagactttattctacttggtttaagcagttggtctgcattctacctatttctctcaactctcattgtccattccaatcaggttgtgcaattcattgtccctgctcataaaccaaattcatttcacctttactccattcccatgctattctttttacctggaatattttcttttgttccaatttcccaatcgtatacatccctcaaggctcaagccaagtcctgtaacttcatgaaatctatttctaacatctgatttccacatggattatcttgtaatagtaagccctgcatttgctattatttattaaagatctcttgtgttctagacgctattcaaagtattttacaaaaattccatgtaatattcaaaaaattcagcaggtatgtattattatttcatgtttagtgaaaccaaagtaatgaaagagttttcatcattatgtggctaataagggaaagagaagagaagggtcaaacctatgtctatttaactgcactttgccatgagttttctctggaagctgagaaaggagattcacaacaagagtagatgagactcagataagaaggaagtgtggaatttgaaaaagcccttcagaaaacaggatctcccctactcctaaaactgctatactgtgaacatattgcttgtctcataactgaacttttttggtactctcagctgaaatttgctctataattgtacagaactttaggccaaatgtttcttttatggggacacacattatttgtttcgtttgcacccattttctcaattactttgtgttttctcttgttgtattggatgcatctctatccactgctacaaatctgtttaatagtctttatattaataagaccatgaaattgctctttgtgtgctgacatagttatcctttattttctaatggcagtgctagatttgctaaaatttaggtagtagcattattaataggaaaaactaccaccaacaactaaacttgaaaggtaatatagcctagtggctaagagcacaatccctgaagtctgactgacgaggttctaaatcttgctgcatttattagctgtgtgaacctgggcatttttagttaaccttacagtagtttcattatcttatatggaaaatgaagataatagtagcccctaccctagagggttgttgagaggagaaaatgagctcatgtatatacagtgctttggacagcacctgatgtacagtaaggttcatgtatgttgttgttcttgctgctgctgctgctgctatggtttttgttatgtaacaactaccttttcccctttgttcattcgttattgcttttcctaaagactacaatcacaaaaaagaagaaaaaaattagagagcatacagtgaatgcagtaatgaaggcttgaatgatcttttctagttaagtcagaagtgaaataaaactatccaaaaatttctatgaaaattatcctttgtccagattggctacccactgagaactccacttgattctccatatcaatcttttgctcttttgtgctacctgagtctgaggtgtagtctttaaatgatgagtttattggcacaagacagggatgccctctctcaccactcctattcaacatagtgttggaagttctggccagggcaatcaggcaggagaaggaaataaagggtattcaattaggaaaagaggaagtcaaattgtccctgtttgcagacgacatgattgtatatctagaaaaccccatcgtctcagcccaaaatctccttaagctgataagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatgcaacttacaagggatgtgaaggacctcttcaaggagaactacaaaccactgctcaaggaaataaaagaggacacaaacaaatggaagaacattccatgctcatgggtaggaagaatcaatattgtgaaaatggccatactgcccaaggtgatttacagattcaatgccatccccatcaagctaccaatgcctttcttcacagaattggaaaaaactactttaaagttcatatggaaccaaaaaagagcccacatcgccaagtcaatcctgagccaaaagaacaaagctggaggcatcacactagctgacttcaaactatactacaaggctacagtaaccaaaacaacatggtactggtaccaaaacagagatatagatcagtggaacagaacagagccctcagaaataatgccgcatatctacaactatctgatctttaacaaacctgagaaaaacaagcaatggggaaaggattccctatttaataaatggtgctgggaaaactggctagccatatgtagaaagctgaaactggatcccttccttacaccttatacaaaaatcaattcaagatggattaaagacttaaacgttagacctaaaaccataaaaaccctagaagaaaacctaggcattaccattcaggacataggcatgggcaaggacttcatgtctaaaacaccaaaagcaatggcaacaaaagccagaattgacaaatgggatctaattaaactaaagagcttctgcacagcaaaagaaactaccatcagagtgaacaggcaacctacaacatgggagaaaattttcgcaacctactcatctgacaaagggctaatatccagaatctacaatgaactcaaacaaatgtacaagaaaaaaacaaacaaccccatcaaaaagtgggtgaaggacatgaacagacacttctcaaaagaagacatttatgcagccaaaagacacatgaaaaaatgctcaccatcactggccatcagagaaatgcaaatcaaaaccacaatgagataccatctcacaccagttagaatggcaatcatttaaaagtcaggaaacaacaggtgctggagaggatgtggagaaataggaacacttctacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcactattcacaatagcaaagacttggaaccaacccaaatgtccaacagtgatagactggattaagaaaatgtggcacatatacaccatggaatactatgcagccataaaaaaaggatgagttcacatcctttgtagggacatggatgaaattggaaatcattattctcagtaaactatcacaagaacagaacaccaaacaccgcatattctcactcataggtgggaattgaacaatgagaacacatggacacaggaaggggaacatcacactctggggactgttgtggggtggggggaggggggagggatagcattgggagatatacctaatgctagatgatgagttagtgggtgcagcgcaccagcatggcacatgtatacatatgtaactaacctgcacgttgtgcacatgtaccctaaaatttaaagtataataataataataaataaataaataaataaataaaaaatgatgagtttagacaaatatcattatggtagtattatattatgttatgttatattatattatattatattatgtataatgtatattccttgcagcctgccctgcattcccaatctatgactcatgctgccttattgatactgaaaaatctccactacagcatgccagcttttgaaagagagccttgggttctttcccaatacttaccttccttttagggcaacctatctgagtcctgtagcttgaaagatttcctaccagcctgccatcccaaaggaacatggatgaactatgtttatgctgatgtgtcaagtcatttcttggtatggttcatagtagtccacatggctcttgtagacaaagagatgaattactgatggcagaatttctgttctggcaacagggaaatttgcagaaaggagaccttttcagtgtgaacattttttgctcacaggtggtccaggatgcccaatgctaaatgagaagtgaaaagagcaatcagggccaggtgtggtggctcacgcctgtaatccaagcactttgggaggccaaggtgggcggatcacgaggtcaggagatcgagaccatcctggctaacatggtgaaaccctgtttctactaaaaatacaaaaaaaattagccaggcgtggtggcgggcgcctatagtcccagctacttgggaggctgaggcaggagaatggcgtgaacctgggaggcggagcttgcagtgagccaagatcgcgccactgtgctccagcctgggtgacagagcgagactctgtctcaaaaaaaaaaaaaaaaaaagagcagtcagaattcaatttttcattcagaacaaatcaatccacgtgggtaaacattttatcaaactcaagaatgctgtctttcagggtgcttttccctcaacagtcacttatttcctcttgcaagtagtatcttcgttcaggttcagtgactactgtgtattatatccaatgcttctggcaagtgggttggtggaggcagcccaagatcttctagaatcaagagaattggatccatttcccagttctaacacttatcagctatatggcttttaggcaagtcagttaaacatccgagtctcagtgctctcatctgcaaaacagaaaatgtgatgtacttcacagagccagggggaggaataactaaggtggtacatttgtacgtgctttgtaacctgtaaagccctttactgtacacgtgtcatttacagctctgtatcaccatcatgacctagaaaagcagtactgacagaagacttatcttcttgccaatgctaagataactttagccatttctgcatttctaaaggaaggagtctttatcccagtatctatgaagacttggcaggaattgccgtcaatatttagttggtaatataaacgaattaaacaaaaatgcacactaggttttaggaaaattaaagacagaactatcatttgtactcctcttacatttcccaaagtgctaaaactagacaataaatcagtcctcaataaatgcttgtttatcaattttatattcatttatttgttgataatacaacaaagatgtttatatgcagtataatatatatggcaaagatgaaaagtagcaaattcatgaatcaacatcctatttatgcttgagaagacaaagaaagtgttggtgacttcatggtatacataaccttaaggagctcgtgattgagcctgggtctctgctatcaatgtaggatataaatttcaaatgtactatcctttatatgtatgttaatgtagtaaacatagaaaactgatgctactagtgagaatacttttacttgaacaactaaaagtttgtctttaatcccctaagtgcatacacaaaaggaaagtactgtacaaatcaagtacaacagaagaagtaaagtaaaagacaagtgaaggaattatctggaacttagatctggttggctttttctcctgaagtacttagataaattaactcacttttctcttttgctgaagaagtgcaaattaggcaggcatgttattccacgtaggcaaaaggaaaaaagaaagaaaaacataaaatggctatatatttgaccaaacttcgttctgcaagaatcccaatactaaccttctaccatataaactactttcaaaatcaggctatatccttccagtacaaacctggtttgtactactcagagatactactcagaaatactttcagtatttcccttctttcaacttctgatgtgattctatccatattcccctgcctgtctcccagtcaaagagaatgggacacaactctctttagagtccatcagtgatgctttagctgccaaaaatagtgacaatagacattcattgtctgtctaccttacttgttcaacattcagaattctgcatcttaagaggctgtggctgaaaacttgagccagttcttcagaatttctaacatgttatttctgccactttttctcccttactttagcagagtaatttaattcaatttgagagagagagagaaaaaaaaaacttttctagttacacagatcaatccaattgtttggagcttcagaatgaatttttaaacttgttgaacagaagcatacaaatctctaagagcaagtcagataatatacaaagcctccattcattgtgtaggcagaaaggaatgctggtacccggcagctctctgaggaatgttcccttggctttgactattctgctgggaacaaggaaggaaacacatatataaaatgaatttataatgtctctggcttgtaatggcagaatgataagaaaagttggctgtttaatataaactgtcagttgcatattccaggcctcctctctttgaggttcctcccacatccacacgcctggctactgtttagtgcggagtacaaagtggccgtttattattattgactggtgaggcctgtgctccaaaattcattctgtcaacagaatgtaagcaaagttggcattttaaagcagggctctttcagtttctgggttttctcaggattgctatgcaacaggatcagtgctgtagtgcccggttcaagctgaaaatgttacacaggaagacataccatgtaaaggtcagattcttctactataataattttcttgatctgtgtgtatacaagtgaagttgaatgcataacctcttatcataactcttaccaaggtcctatgtactttccacctgtcaagcctaaaaatgtgtattaaatgggaaatcaaaactaataaatgtatgatgctgtactatatgtatgatgctataataccaaggtgaacttaatttgtgttgtcaagaagattttctctcccatgacagactcccaggaatgtgctggtgctgtgggccaagtgcaatcttgtttattagtctctccacgcttttatggtcagagttaactctacagattactacgtaaatagaaaatatgacttgatccatatagtaatgaaattattggcactggggtacactttatcatagaattttattgcctatcacttccataaaataatacattttgtccatagactagaagatataacttgtgaactttataaagttataaatacattactttccaactcataatggcaaggaataaatctattacaactaataagatgcccattttaaatctacataataacaggagaaggcaatacgccaagaaaagggatttgagatgtatcttcttgttagtttagcctgattgaaatgtcttttgaactaataattatttatattttgcaattctccaaattcacattcatcgcttgtttcttttgtttggtaattctgcacatattcttcttcctgctgtcctgtaggacctccaaggtgaaattgaagctcacacagatgtttatcacaacctggatgaaaacagccaaaaaatcctgagatccctggaaggttccgatgatgcagtcctgttacaaagacgtttggataacatgaacttcaagtggagtgaacttcggaaaaagtctctcaacattaggtaggaaaagatgtggagcaaaaaggccacaaatgaattaaaatggccaaattttcctcattgtcttagcacaagtaactggtatctcacatgtctacgtaaatcatccaatttcagaatgattcactgtattttgaataaatgaatcatttatttgcttggtatggagatgatacttgaggattcagattagattaaagtggtaatgttttataaacataggagacatgcatattaagacatcagagtgaatttaaatgaggagtgcagctattctagtttcataaatttctctcttggcatatcacagggttatacaaaaagtgataaaaaattaacggatatgtattatggaattatttttggcattagtctaaatgcataccagaggacagtctttaaaaccctttataacacattacaattatataatataaaacctgtaacacattataattaacagtttagaggagatagctcctacagttaaagagagactatagcaacttcctgtcttttgcttcctctcagattttgttaaaacacatcctctgtaaactaagcttttagttgtagtatactcacatactttatattttgcccccttctatgtgccagctttctttggagaagttagttaatggatgcatcatagcatctttgtaaaaagggcagagggaagttcttgttataccagttttgcaatagttccgtggaggaacaaaaggatagagatagtaagtaaaacgcccattgtaacttaaatgatctagcaagggcggggaatgaaagccaggcttcctgctttctaagcagttgcctttcttaattcatttctctttattaaaaatattttgtgctttcttctgtgtctagagaaaaagtgataatgaagggaggtagaagatgaccaaatggacttaataatagttatgggagtatacactaaatgacgggagtagttactacctctaggtagaaagattacagaagggagattttttttcttctttatagttcttctaacttgtccaaaattttaacatatatacttctataaggaggaaaatctgcatttttagtaattcagaagcactattgtaaatgtctgcatcaagtatgaaataatgatagcaactaatatttacatgatgtacctacataccacgcaatgccataagcactttccattcattgaccggtttaatgctctcagcaaccctaagaggtagattttattattgaattctttttacatttgaagaaagtgaggcacagagaggctaaataatttccttagggtcacttagcaagtggaagatacaagatgaaaacagggagtctgggtgggccaggcgtagtggctcacgcctgtaatcccagcactttgggaggccgaggcaggtggatcacgaggtcaagagatcgagaccatcctggccaacatggtgaaatcccgtctctaccaaaaatacaaaaattagctgggcatggtggcacgcgcctgtagtcccagctactcaggaggctgaggcaggagaatcgcttgaacccgggaggtggaggttgcagtgagccgagatcgcaccacttcactccagcctaggggacagagtgagactctgtctcaaaagaaaaaagaaaaaagtaaaagaaaaagaaatcagggagtctgacttcagagtctgaacttttaaccaccatatgataccgtagcatataaagaaagaaggaaacttctacaaagaaatgcatactaattgaaaggatgaaatagagagtagattttttctaggagtagaaaaggatttgtttttatgagaagtagattgctaggagtagaacaggtttatttttatgtataaggttttgttttgttttgtttttcacaagtttgcaccctggcttcccagacattgttccttatctccctattttgtatatgaattttgtgtcaacttggtggtggtacactgggagcaacaatggcaatagcattttcaaagatagggaggctctattagctttctacagcttaaactcttaagagaggtcagtatgtgtgatgacgtaggccactttgataaccttcgtcattaaaaaagaatgaaaatgtgagatggaaaaaatattggcaggtcaagttaagttattcttttctgcacaaaagaaaaagaaagatgctataattgttccgagtatcacttagtgccttttctctgcctcatgtgaacttgataaaataaaaggagaattgaaagtggcaaatagcatgtcagccaaaatatggactcttcattctcagcagtttcccatgtcagctaccgcagtttgattcttgctgtcattaatcaggtagaaaacagttagcttatctaaggtgctgccaattctagaatttaaatattcagatcaatggttttggcttttatataggcctatgtaataatacaggatatgttataagcactcataaaaagcaaagaagtaattctccacatcaaagcaatttagcttatttcctgacacttgattgaaattagggtattgatcaatctacagcaaatggcagggttcaattgagagaagtacagtataggcagtaattagggatgattatgaaatagaatagaataacactggaagagttagatatagaaccattagtggcactgataaacctgcattatgaatcttgtcacttcttccatgggggttattttaaaatgaaaagttgccacaattaaaaaatagtttcaatgatatactggaaaaataggcctgtgtttgcccaagttataacatattataaaaaattacagttggcccattgtttggtgagcgattctgaaactgctcttatatttcaaaaaaataaaaccattaatgtgtccatttttaaagaaacaaaattgaatttaaatccaaatgatttcgaagtttccctttgtattccattggctcataagagatatccttgtgcttccaaatacaagtccatattgtatcgttttccttccatttatttttcttctgccatacatcttttctcttcctgtgattaagattcttatttaagtcatcatgttatgccatattgatacatttgcaagaatactctaccttggacgctgtttatatcatattactcttttgttcaaagcttcaatcttgtaggtctccatatctccctcattcatttatttgttcattcaacaaatatttaatgaatgcctactatgtactaggcactcttctgggcacggaggatgcaaccatgaataaaacataccaaaaaaaatcactgctctaatgaagttatatttaatcattagaatctagtagaaccttctctctctgccaactgtgcctaataagtccttgctaactccttcccttctcttttctttttctgcctccagttcctttctcaccaagcatcattctgttactccccaacatagattctctgagccaagagaatcaataaattctattttctaaccccattcctactctccaacaatttcctcactctcccatatgagtatgtacccttgctggttctcacacttgcaacattctctttcctcttattctccaaattttgattcatattccataacaaatcttttcttttctggctgtttcctcactaggtcttcccaatactattctaatttacacttgataacatgtttcttcaagtgttcaagagttgctttatagggctatgcttactgcctccagctaacttatatgaatacaaaaatttcaaactcgaaatatgtgagtatggtagagtagaaagacatgggccagcagctgggcaacccagtttcccttctgttctattctgtcactaactgtcttagcatataatcttgatcaagtcacttaactgcttcagacttcaattttctccttcactgaaatgaagagtttgaccagaaatatggacagtctcttccagttctcttgcaatcgtacaattttattcttttagttctgcaatcacactttatgaacctggaaaattgtttaatttttctaccttggttttcttaattaaaatagaactgattgatttaaaaggcattatataaagtaattaagatgtctttgagagaaaagaaatttaattgaaattgtataatcctatctcataatttaattcaagaaaagtatatgctatcattccacatgcattattacatcacatgttggccaagaggtataaggaagaaaagtaagtagtcagtgataatttaagttccatcaaacaaaacgaaaacattaactgctttaagtgggagaaaaagagaaaattatttacttaaatgtacacacacatgcatacacacacagttactgatgacgttatccaatattaagatggtaattagtcaaagaaagtgtttttcattctaaaattccatatccacaatccttgcatttttaattttagaatattaataacttgagaagtggtcaagtcaattgttttacataagaaatatatatgaagatttcaatttagtctactactagattatttttccagatcattgtatatactattaactatgaaaatcacataatatgttatcaacataatttcagcagaatttacattatgtgagatttttatatttggcagaaaaatttgtaaatgttatataaaatgttcacatttatacaattgtgaacattaagaggcaaggacactgacattatatagtctgtagaagccataaatctattggggagtgcttgctattagaggttagaatagttagtgtctttgtataatggagaacaaaagaagggcaaaaagaggtggggtctacctttgagagaaaactgcaacttggacattgaatatctctgaccttctttctctctcttttagaatgttaattatgtttggatgttggagttcaagacctgtctagaaaaaaaaaatgttgacttctctttgggattctctctatttaaagagatagctcccattttaattctgtggttctttaattttttttgtttctgaagtacaaattcaaattattcatctgttgatgacaccctggagatttttctcagtgttctcttgtagtagtttcatggtttgaggtcttacatttaagtctttaatctactttgatttgatttttgtatatggtgagagataggggtctagattcattctgcatatggatatccagtttttccgcaccatttgttgaagagactgtcttttccccactgtatgttcttggcacctttgtcaaaaatgagttaactgtaggtgtgtggattcgtttttgggttctctagtcttttccatgggtctttgtgtctgtttttatggcagtattgtggttctttattatttctgcattcctcccttttctttctgcatgtttaagtgctattttattacatgagggtactaaagatttatagggatatatcattagttttataaaggaagtcaaagtgaaaaatgaattcaatataacacatttcactttaagaatgcatgcctttcagagtaaagttttattaaggatttcaaactaggcattaaccaaatcacagttgaaatatctgtgtctagagaaataacaatcactttatcagcccctataattcttagtgtcctgacactgaggagttccttaaagaccaagcaatatactccagcacatctaaaggctctgcgttttacctaaaccttacaaattgtggaaattatcagctttttagagattagcacttgccttgttaaacggtagtaacccctaagctcttgtcttcactaataaagattaatagacatagatagaagctaagcatgcccctttgaaccacctcttttattttccgttgagtgggtaggagtaagcagaatatatttgacaattagcaatgttaaaagacaaactttagacaaattccgttttgcagagtttatttgagcaaaaaacaattcatgaatcagacagtactcagaattagaagttcagaaagctccacccagcaaggtgggcaggcagtatttatagatagaaaaaggaagtgacatacagaaacagcttgactggttacagcttagaatttgccttacttgggcatagtgtaaataggcatttgccttatatggacatgagctgatcagtttacagcctgtgattagctgaaacttgactgctgggattggctgaggctcagctatttgttacaagaatgtactcttaagttgcatattgcttacatgccaagctgggttgcagtttgctatgtacagagtcagctttaggcccaatttaatttaatttaacagcaacaagcctttttgttcagagatcaaaaacatttggttaaaaccactaaggtttaaggattttctcatctaacaaaggtttgtaatttctatttcccatatctaaataggacagctcaagttatgtttttcagcagctgttttatacctttgcaatcttgatttctacatatgcaaaacaagaaggttgaactataatctctcaggttccttccaaccccaacagcctatgtatgatataaccagaaaaaaaagtcattacaaatacaaagaaacattttcaggaggagatattccacatgcaaacataggttaatcatttcaaaatatctggtatatacactcatgaaaataaaaatagggcaactgcttccgataaatgtattagaaatgtgacttgaaaacatttcacgggcttaacatggtcaaagaaaatgttttgagctcacaatgttccttacatttagatcttcaaaatcaagtcactgacaaatgccacctttgccctgtggagaccaagaagtaatgtttggggcatatcagaaatgctttaataaatgctttatcaaagaatggttctggagcttacctgtggaattgtgaaggttcttgttgaaagcagagattgttgatagaattatagaaagtctggaggtggcacctagcaatctcaattttaaacaagctactcaaatgtttcttatacacactatagtttgagacccagagctttaggttgaatacatttgtatatgctgttttaattcattctctggctgcctttcacctcttcagttcttactcagtgttctctgtcctttgtaagtttttcgcttcagtttttgtcctcctatcacatttttcctttcactcttgagctttaggagaggaaaaaaatgaagcaatttgatatgtagttaggatgatcaaacattctgaaattttatctaactccacagcttagaaaaaaattaaaggaagtccccttacccagatatgtgagagcttttcgtcttttgaggttccaggtccgtcttctgctgctgtattagctctcttgactgtcctctgtccctggcttctaacaacttccctatttcatgctattaagtttctcttagatcctttagaactgaattcccggctgggtgtggtagcttacgcctctactcccaacactttgggaggctgaggcaggtggatcacctgaggtcaagagttcaagaccagcctggccagcatggcgaaaccccatctctactaaaaataccaaaaattagctgggtgtggtggtgggcgcctgtaatcccagccacttgggaggctgatgcaggagaattgcttgaacccgggaggtggaggtgcagtgagccaagatcgtgccattgcactccagcctgggtgatagatcaagactctgtctcaccaaaaaaaaaaaaaaaaaagaactgaattccctaggtctcagttattttgctctctcttaggggacctaaaggggttcattgacccactaataatgagtcagcaccatttaacctagaactggaattttagcacttccttacataaacaaagccgcagcttgaggtcttaacataggcagcctgcccttcactatatcctcctctagacctctctgccacaaggatattttgtttcctctaccaggcagacagaggccaaacattagtcatcgttatattctctcttcccttcctctctccctactccccaatgtatcctagagacttaggggcagtcaataaatatttatttaatcagtgtcttttctaccatttgctgcttttccatgtctgagccctacctctctccacctacttttcaatatgtcctgcttgacagcctcttttcactctcaaagggaccaagctgtgaattccagacaccccaaggaattcgtttaaccattacacattacatgctattaaacagctaaaatcttgcatggggaattgtcgcttaggcttatcatggaaaagtggtaactgaaaggatggtacagaaacataaaagaactgacctctaattgtatgcaatctgcatgcactattatattcaattcatgacatttatggtatttcacgattcagttcttgggaaataatacccttagagtctggaacaatttaatttatcttatttgatggaaatgccttcatttttcctggacatattgtttatactgcaattatagaaagaaaatcttgacaatttggaaaagtagaaagattaagaaataaatcacctgtaaatctacctctgagggataacctggttgtcattacaaaattttttcctagtcaagcatgtgcatacaaatacatacacatacacaaatgttttagaaaaattcaaaaaatgtatttgttttgtaacctgttttctcatttagtaactgggatgatgaccttttccatatccataaatatttggctatgtcatcatattgaaccttgcaaaggattttactgtatgaatgcaccattatatatgtaataattcccttttaaattaagagctatttaattaaattcatatataaatttcattaatttctaaatttaaagcatatacaagtttcattacatttgaaaacaatcagtaggttggggttttgcatttctcaagcaattccctcatattgaatatttaagttgtttctgttttgttttatcaatcataaatgatgctatatataacatttttccacctatatctttgtatctttttccaatttctttgttagtataatttccttgaatttaagcctgtgggtcattgtctttgcacattttaaagacttttatgtattgtcaaattatccttcagaaagtttggaacaatttaatttcagtagataagtattctttggtgattctgtttgactaaggccaaaaggagaattgtatttgtaatgtcaagctaagttaccaaatggctaagggaaatgttgctccacctggttgctttgctttacatttcaatctttgcagcgttaaagtctttattatatttatgttataggtagcgttattatgaattaattagtaattgctgataatagctgagtgattgagcataatttctaatttacctgaagataaagctttgctaacactgcgtttcctctttgttttctggatgatgatttattttattaatttagcttctcatcttcaagtgaaatgtggattttatagcacagatcattcatttgtgtattcttaaatggcttctaaggattaacgtgttctaaatacagttgacggtaaagcactcagtctcctgcctaaattattcatgttcgggggaagctttcagataaatgtctgattttactcttccatgtgagttgttgtcttagtactttttacacaaaggaaacaaagcagaaaatgttgaaacttggtgaagacaaatcccaggtgcacacaaataaagaagggtagggggaaaggagacgcatttgggaagaggagcagaaaggaacagacgccagatggaagaactcaatggaaaaggctgcctagggtgtagaaatggaaaagtcaaaatgtggggagagacctttccatttctcaaggcaaaaagaattccagtactagcatgagtcacatgaaaacgaagtgtttttcattagtcactgcatccaattttttctaccagaaatattaagaattgttgactacaacagtatggaaaagcaatagattccagtgtgtatttcatgccaaaagtctcagcattctgcatgtggaaataaacatatggctaaacactgccttttctcaaaattgccatcaaactatcctctgttttgtggctctcaaaagtaagtagccagatttttattcaagactgctttgtagttcacaataggtttattgtactttttcaatggaattgttagaatcatcaattacacttctagatattctgacatggtacgctgctgttctttttcaggtcccatttggaagccagttctgaccagtggaagcgtctgcacctttctctgcaggaacttctggtgtggctacagctgaaagatgatgaattaagccggcaggcacctattggaggcgactttccagcagttcagaagcagaacgatgtacatagggtaggacatttttaagcctcgtgccttgcacatgttaagcacatagtaatccagtgactattttaaaattaattttgtttgaaattaagttgaatagaaatcttttttactcttctcacccaagggtcaattataaataatctaagccattacactgtaaatgtcaaacacatttgtgttaataataccctttaagaaatcgtccatctcttttggctatataaaaaaaagcttttcatgatgaaaaatattgaacatatacaaaagtagacagaatgctataataaaactcgtactcatcaagacatcaacaattatcaaatcacgtcagatcttatttattctatagctcttcccagattgttttaaaacaaatatcaggcgtgtgttattttattgttaatatttcaaaaggttaaaagataggattcactcttttaaggtaatcaccttgctactataatgcttttgaaatatcaataatttcatcatatcaaatatccagtccatattcaaatttccatttttctcatacatattatgcattttttaaactttttctggttttggtttaaataaaaattgaaatcagacccacaccttactttggttagttggtctttttattactttttgtttggaagtaattacagattcacagtaagtttctaaaatagaatagtttccctgtatctttcaccctgtttcttttcatcattatatgtcatgcaactgtagtacaattcttattgtcatttcaacatgcaatcaatagaaaaaatgtacatttacagcacatctcaattcaggctcattacattccaagtactcagtagccagatgttgccagtagctaccgattgaacagtgcagttctatagtttgattgtatttgggtttggctttttttggcaagactgcttcacaggtgttcgtgtattcttccatcatcaggaggtggtatataatgccttgttttctctttttgtgtgatgtttaatagctgttcacgatcagtggctaggggttgcagtgtgataattgcctatctctaccattccttcttcatttattcactggggtaggtctatgaaaaaaatgttttgcacttgtctcctattttggtactcagtatacctttcataccgaacaagcaaaatacgtttcaattttaccaatttttataataacaacttgttcactagcatcctccaacgatgaccaattatttctttgtttgtttgttttatttttatttacatttctatcttctctactaagctctgagtgaaaaaggcagagattttgtcttgttcacctccaagaccctagagtctagtaaagtgtctggtgtagagtggatactgataagtgttttggaaatgagaataaaagatacaagaacagaaatgaatagcaaaccaaacaaattactaccaaataataaaaacttgataaaatggtaccacttttgtatgttgagcatgtaaaggaaagatctctgtggagatacagccaaaggtggcatcttgaggaaaggtcaagggtttatattattctggagaagaggatataggaaattataaaaagggaagagaacatgaaagaagacccagggatctttgcaaaaaaaaaaaaaaatgccagggaaactgccagtttctcctttagccatttgccttcatatatttctgaatattaaattagcttttgtggtagggtgaaatgtaatggtgctatgtgttttaaatgttctgactttgaataaacagccaaaacactctggtgtacatatagaaaagcactcattgagaaggatgggccttttttaaaaaatgcattatgcgatatagtgaaatgagacagaatttctacaaaagatgaattttatgctagttccagaaaccaaagaaaatgaatcactggacatgtgcactaggagtcaggagactgagattctagtcatatttcttcataagatggattctgattgctattttgttcttcaactgtaatatgaggaaattggtccaaataattgctgtggtttcttccagccagtattttgttataaatactgcttcactattcctggttattagttttggttgcttgttaagagtggtaaaatgtctgtacttaacgcagtccttactcaggaatctcatgacaaagaacatgacttggggagatggtgatgctagagttatgagtgatactcaccagaatgaagttaatccgtccccacttggttagtgtgcttgctcagatagctacctgttaacctttcgtgaatttcacaggacttccagcccattgattactctgtgttttatacattagttcctctgcccttccatatttacctccttccaaatacaacttagattcaatcatctaaattttaataacttgttttcaaaagtctgaaaccctttgcttctttatctttttgttgctgcaatctacaaaactccaaaactctagctaaatattccgagactctaactaaatattttctcataccagacaacaatgtagttgtctggtacagtaccttttccggatgaccagccttcagccttccactaccaagacatcactgggtcaatttttttttttttttttttttgagactgggtcttgctctgtcaccaggctggagttgcaatggcacaatcttggctcactgcaacctccgcctcctggttcaagcaattctcccgcctcagcctcccgagtagctgggactacaggcacgcgccaccatgcccacctaatgtttgtatttttagtagagacagggtttcaccgtgttggccagatggtctcgatctcttgacctcgtgatctgcctgtcttggcctcccaaagtgctgggattacaggcgtgagccaccgcacctggccaatttaccttcaaaattgtttttgactgtctactattgttatcatcataattatagaagaccatttctcctaacctttctgcatctactcttgccaccctacaatgcaatctctacatttcagtcagaataatctgtgtaaaaaacataaatccaattatatcagtccttatcttaacactatagtagtcttctcagtgctcttggaaaaagaccaaaatcctcaacaagggtgacaaggcactatctggcttgtctggcctcagcctcctctttcctagatgctcttcccttgctgtttggatgccagccatactgcctccatttactttttccaattctgcgtgtccctcttatgtggggctttaaatatgttggtcctctgtctcaaacccttttacctatacccacccactcataatatcctggttatcatctaataatcctttacatcttggctcggacattgtgcaaacttttccctgttgtctacatttgaccagatctttctttacacacttctaaaattgtctacttttctataacatagcgttgtttgtcatcacgtacatgtgttactatttgataaatatcgactactcttgctaaaccatgtccttcaagaagatttttgggagggggaaagctgtcatttttctactcagcacattccaaagtgcctagtatacagtagacactggttagataaaggaaggctattgagaccaagagcagggaaagaaagaatagagtggtattcccttcttatttacaggagttttctgtttatttctaattaagcatctttttgtaaagtgtgtagagctactttgatgcacaggtttttttttattattatactttacattctgggatacatgtgcagaaagtgcaggtttgttacataggtatacatgtgccatggtggtttgccacacccatcaacccgtcatctacattaggtatttctcctaatgctatccctcccctagccccccaccccctgacaggccccagtgtgtgatgttcccctccctgtgtccatatgttttcattgtttatctcccacttatgagtgagaccatgcagtgtttggttttcggttcctctgttagtttgctgagaatgatggtttccagcttcatccatgtccctgcaaaggacatgatctcatccttttttatggcttcacagtattccatggtgtacatgtgccacattttcttaatccagtatatcattgatgggcatttgggttggttccacgcctttgctattgtgaatggtgcttcaataaacatacgacatacagcttttacttgtagtttggcgcaatgctttttcaagcttctcttggtatctttaagaaaaattcttgacacaaaacactctccttcctcaaacaacatcatcgctcctgagtgctgatgagagaacagtttagtagcctgtttgactcaaagttttgtcacatgtatgtggtagccctttcatatatggactgtctagttagtgatgctcttgaagcctatgggcaaaagaacaatggaaaatccttgaaactggatctgcgtatcagatctcctgaactcagttagaaaaagagaaaaagaacagaatcagtacaaaattccatcaagatctaatagttgacagatcttatatttgtggacttttgttttactttgccatgtttccagaattgtacattgtattgctctttatgggtttcttgatttaattgttgtttgtatagaatccttggtatcaagatgggtcactgtaattgtaaacttattccgcaagtatttagagtgccacttttttaaaaagtcatctgcttactctctattctaaattattaatatcctttgctgatgctttttatggggatacaaatcccattaaaatgtcaatagttgaaactaaaatcaaatgttgttcattttcactttcattttctataaatcaggatgtttacaaaacaggtaatttgtgtttttctttgtataccatttcagattagtgataatattttgtagcaaaatattacatatcttgtactcttttcttgtagagaaaatatacagtcaatatcaattgctgtcatggagagatatatggttcttctgtaggtaaaattccaagatactccacagacatatttggggaccatagtctcactcctcaaagcaattttcacacccatgggagtagatctgtgctccccaaaccagctgggcagcataacaactgcaactgaatggctctcaagactaattaataaaataatgctccagatgcggtgaagtgttataaataattaaagctcaaatatgccttagcaaatataaactgaccaatttttatgtcttttgaatacattatcctggcttttacagttcctcattacttgcctcactagactgactcgttttcaattagtgggtgttattctggtccagatatattttaaaaactgacttcctttgttttacttgagcagtcactaaagtgatatttattacttgtctacttctgtgattaacctagagagagttttaaaggagcaaatcatagtggggaatttctaaggagaactgcaataaaacatcagcttattcaactcccttcctcctaccccaaatccaaatggagattagatcttgattgtaacaacagtgtaggtaatgactttttgtttgcctttttactaatgaaattgtttgtcactaggttttcatctttcaattaaaaaaatctctataatcccttccctagagatcattaaggataccttcaaagcttcccgagattttctggttaagatttagatggaagtaatcaatacatacattattaaaagagtggacagaaagccattattgcttggatgctgttgacaaatgaaaaggcttgaataaagtagtttacttgttcatttgtcaggtcatatattatgcatgttcgatttcttcagaagtcaccacaaagtgagagacaggctgagaaattcaataaaattatcctgaaatcatgttgtagattatacatttatttaggctcattctgttatcagtgctggcctgcttacgtgggatacattttagtatgtatgttagcttgacgagttttctgtgttttctttttacagaaagagaaaatatctttggatgtcatttgtgaatgttaagatttaagtcagctctgtgttaagaaaaatgcgttgttccctatcacctctgaaaaacaaccaaaagttgcgatagagtgattcattcttttttcttttctttttatttattttttctttaatttttttttgagatggagtctcgcctgcagcccaggctggagtgcagcggtgcgatctcggctcaccgcaagctccacctcctgggttcacgccattctccttctcctgcctcagctgggactacaggcacccaccaccacacctggctaatgttttgtatttttagtagagacggggtttcaccgtgttagccaggatggtctcgatctcctgacctcgtgatccacccgcctcagcctcccaaagtgctgggattacaggcgtgagccaccgcgcccggccagagtgattcattctaacattcaatgacctggcctcttagagtttctaaaccacttgactgttagttatatctactctaaggtgtctttttagccgcgttggaggaaatagacgtctttttgatctattcttcatcatttttgtataagtttgatatcctatgcagtcatatttagggatgctgaatagaaatgacttaaaaattatttttagaactgcatttctaggcatttgagtcttctgaaaactaagtctaagtcttctgaaaactagctttatcatcaaaactgaagaactgagtcatctaggaattgctgctttgctttaatgactgtaacaagatgagatgtgaataatttacaaactgacttctctaccagtcttctctctcactttgtcaaaatattttgatgtcctgacaaatactctttaaaacagtatctgcatagtgttttgccttgacaaagcacttttacacacattattcatttaattacaaatgatccccttgatttttttctgtgctcttccttttgtcccccaaaaacattattttaggaaaaattataccataactcagattcctagaatttattggttctttcaagaactttttttatgaagagcctactctatgttaagcatatgttagggaacaaaatgagtctctgcccctatggatgtttagattttagtgacagaaatacatagtaaacccataaattaatatatgaaattatgttgggtagtaagtgctatgaagagaaaataaacaaagcatgaatagagaaagattgaggagtactggcctatgtgaggaggttattttggggtaaagacttgtgtgaggccgggtgcagtggctcatgcctgtaatcccagcactttgggtggctgaaacaggcagatccctggacgtcaagagttcgaaaccagcctggccaacatagtgaaactacgtttctaccaaaaactagctgggcgtggtgacacgtgcctgtagtcccagctacccaggaggctgaggtaccagaatcgcttgaacttgggaggcggaggttgaagtgaaccaagattgtgccactgcactctagcctgggtggcagagtgagaccctgtctcaaaaaaacaaacaaacaaaacctgtgtgagtgagtaaaccatgcaaaaaccttgaatgaagaggattctaggcagaagaagcaccaaattcaaaagcccaatggtaagaacaggttttgagtgttgtagaaatagcaagatgagctgtgtatctcaagggaaataagatcagtagacagtgataggttctagaaagagggaaaggccagataatgaatggtcttgcaggccatagtttggaggtggattttattctgtgagtaaagagacatcactggaagtaaggaaacatcactggaaggctctcagcagggatgatgtgatctgatttatgtgtttagaagttgactcttgctgctatggagaattgactataaaaagagcgaaactgaagacacagaaaaggagggtggtggagtcatctcagaaggaaatgattacttggactagagtggaaatgataggtatggtgaataattatttgatcgaagatatatttggagggtagaattgatagaacttaagatagatagaatgtggagtttgagaggaagcaaagagtcaaggaaaattctgaggtcaatggcttgaacaaataaaataatgatgttgccatctgagaaagacttgggaatgatcacgtttgagtgtatgtgcttagaatgaaccagggttccatttttggattatgttgatagacagacacaaagggtatgattcagatattatttaccacttatacttgacaatctcaaattttggctcagtatcttgagaacatacacaaattaatttgtcacagggttttctaataatccattcatttctactaacatttcagaagtaatttccaaatcttaaagtttaggcttaatgacctaagacctaattccctaaatggccacgggaactagattgagttttcaccagtgatctctcaaggtcagctcagaacttaacaacattattgtcagtaggaagtaacttccccagtgattgttggaagcagcccagccttagaattaagagtcaaacagctgttcaagatgctgtgtgcgcagtaaactattcctccatagtatcacagacctgcaagcaggctggactattctagcccgtgcccttgatctcagagaatacaatctttgttttcaaagacttccagaaaaataaatctcaacacagagtttgttaaacacattttccccttatacactcaaaaatgttttttcattgactataattagatttttaaaaaaaaaacataatttcaggcctgaaatatgttcatttacttttcaattttacatcaaatttattcaatctcatttataaattaatattgttgttcatgttgttgactatctgaaacaatgaatggatgtatctgatacttcaatcccttatcttcacttttattcagaagtggagtgaaaataaggcggagctttttgtcatcttatttagatgattatttagtcaaactcatagaagcagagagtagaaaaatggttgccatacattgtaagggcgagttgttgctcaatggatataaagtttcagttatgcaagatgaaaaagttctagaggtctgctgcataacattgtgcctatagttaacaataccgatttgtgcacttaaaaatgtgttaaccgaggtccggagatcaagaccatcctggctaacacggtgaaaccccatctctactaaaaatacaaaaaaagaaaaaattagccgggcatggtagcaggcacctgtagtcccagctactcgggaggctgaggcaggagaatggcgtgaacctgggagacggagcttgcagtgagccgagatcgcgcaccactgcactccagcctgagtgacagagcgagactccgtctcaaaaaaaaaaaaaaatgtgttaacagggtaaagttcatattaagtgttcttatctcaataagaaaagatgattatggccttttctttatagcccagatacccatgttcataacttctgtaatactagctgtctcaaatgactattaagggaaacctctctttctgttgtttgctccattgcctctttcttcaaatttttttcttccatgaacccctatgaatttgctttagattactgggggcaatattcttgccaccctgccatgtacatcctggattgcttgcccttttccaagacctcgcttttaagttaactgagcattgcttgtcccgaagtgagcatttggtaaaatattcttatgtgtttgagactcaataaatatggtggctctttaaataaagaaggtccttttggtgacagaatatattcagcaactttcttgtcagacatagaaacaatacaggagacataaaaaataaggtagaaataacacaggaacaagaatgatgacgtaggatggcaaaactagtaaatacagatcaagttacagatatgactgttaacatcttgttctatgcctgctcggtatccatttgttgaatgaacagaactgttggatcatcctacatttcagagcctgtctagtgtcctctcatctcctacctaatcctgcagactacagaaaaagccccaagcagcagttcaaaccatggaacttctgagtgtttggacatgaaaatctcctttaagaaatcactaggttgaagaaggcaatgctaatgggaccacttcttgaggaaattccacccagtaactcagcagtgacactcagctttggatctggaacatgagtagacctagaataagatctgtccatttttcccaatttacagcattaattttttcacttatgattcatgagtccaggctttcccctgcaagcctgttttgcatctaaatcaacttggccttcatataacacactctagtgttctaactgggtgttctgtatcttagtcaacaatgtttactgagcatttactatatgccaagctatggctatggtttttaagcatcgataataacgatgcttagcagagactctcaaactgccaccatagagcaggcctgtggccgattaatgatcttaacaaattgattatagtatatgagaactggatgttagaacttagataaggttttagcaaatgcccacattttacaaatgaggacacagaggagcaggaagagtttatcaccttttctggatcactgcagccaggttctggcccagcccaggcttgaagcccaaggcttctgccactcagaacagtgctcttttcaccacttcagcctgcctcccaggatgattctaggaagttctgcttacaaatatgggtagtatttctagtcattccatcagattttattctgaaaaacacaaatttaccatttcaatatgaatacaggtaaaattcagcgccaggcaagctgtacatgattgaaagacatctgtgttttgaaaagcacgggcttttactcacatccatagtaatatgatcctaaatccactgtccccaggagaaagcaagatagcttttctccctgtcatgtcattacctatgcccagagttctcctcttgttcctctcatgaagcaaatcaatatctcacctttcatcccctccatacgtggttctgagctacttctatttatggcattatttagatatttttataatataagcaggaagcaagagggacagaaaaaaataatcagtggccaggtgtggtggctcacacttgtaatcccagcactttgcgaggccgaggcaaacggatcacctgaggtcaggagtttgagaccagcttgcccaacatagtgaaaccccgtctctactaaaaatacaaaaaattagcagggtgtggtggcgcgtgcctgtagtcccatctactcaggaggctgaggcaggagaatcacttgaacccaggaggcagaggttgcagtaagccgagatcgtgccactgcactccagactgggtgacagagcgagactccgtctcaaaaataaataaataaataaataaaaataataataatcaataacttggttcttctctattactttcaggaattttttaagtttctgatttcttccatggccattaggattttccacttatgtggcttccaaattattctaagtcagggagattttatgttttgttatcactcactttcagcttcactttagaattgcaagatttagattcaaagtgtgtaattaactgatggccttaggtaaaccctaacttatctgtatctcaatttgcatggatgaaacattcataatataaaagtatacaccacaaatatacctactcaaccaaactattggctccttaatgacaaagattaagtctctatatctttcctaactttgtacctaataggttcaaaataaatattttttgaatgaacaaattagtgagtcaacaatcagtcacccggttggccagtacctatggtgttttaagtgcaatctaccagataattcaaccttcataataaatagatttatcttgagattatcattgctataatagtgtagtagcatacttcatataagtttattttgtgaaccttaagaagctcaaggacaaacatctgtgtagtattcctaacattttctaaattgcatattttattttcatagaggtgctctacgtctttagtattgcttctaattctctcatatcactattttggacccttgggtctggctgtcttggaaaggtgaaaagaaaggtatggggaagaggatgtgttttaacaaagataattttatctgttcaagggattcaggaagtaattatcttaacatctgaatgctaacatctgaatattgtaaatacgtattctgtatgtacatgggagaaaatatctatatctgataccttttctatcatcacataaaggaactgacttctctggtttaaaatattaaccaaaatttatatgacaaaatcagtatatatgagtatatattttctcaaacctctttcaaacaggcctttttgggagacaagacacttatcaaaatcaaggctcttgacattaaatattcttgtttgtctttttttaaaaaaaagtcttcatttttctttcttttaaaatgcaataaattatactacaacatgcagtttatggtgagttattagatactgaaaaattggctttccattattttaatgcagattctacattgctttttttttactacataaagccatttgttttaagctccatgctacaaagaccacagatgttcattgcctagaacagtgtctgatacatagtagttgcttgaagtttgttaagtgactaaattaaagaggatcttacatataaccatgtttaaaattacatattgttatttatagtttttcccacatgataagaattattgccattttctttaacctctgacctccttgaaccaactatttctctctttttgtgggagttttatccttttgtatttaatctgaatcttttgaaattctaaagatacaatcacttaaccctctcttccatccactttcttttcttaatttcaggcaacaatgtgaaaataatggtgcttatgtctttgtaataacagaactttctttgtcttttctttggcctcattttaatcttcaatgactcatatttaagaaatgaactgtgcagctgtggtggatctaagtccttggcaacaactcgatgggcaaacacgtggtctctcacaatggatgctccttagctttgaattatttactgtccagttttaacaatggaattatatcatcaaatagtgccttggactttttaagtttttagtgccttaagtttttaagtttgatgagacctttaagatccatttccggccgggcgtggtggctcacgcctgtaatcccagcactttgggaggccaaggcgggcagatcacgaggttgggagatggagaccatcctggctaacacggtgaaaccccgtctctactaaaaatacaaaaaattagctgggcgtggtggcgggcgcctgtagtcccagctactcgggaggctgaggcaggagaatggcatgaacctgggaggtggagcttgcagtgagccgagattgcgccactgcactccagcctgggcgacagagcgagactccatctcaaaaaaaaaaaaaaaaaaaaaaaagatccatttccttattttacagaccttgttccaacaattatctccaccttctgtcaaggtcgtaacatatatctagggtgaccaactttcctcgttttcctgagactgtccaattttcctgaaactattctggttttaacatcgaaagtctctcatcctgaaaaactcaatgctggacaaaccaagatggttggttaccctactgctagcttccgtctttcactctaggttcaaatcattcctatgctaaaaagaacttcttatccctttgtcttgttatcctctctgtcctcctgtcgtgtcttcctcttttccttctcagaaaaagaaaattgaacatttgattttcacttgaaatacctactccttcttccactcactcctcagctatgcctacttctgaggcttctgccctccactgaaattgctctcagcacatctagtgaacactctgcaatgctgatcttactttacttctgtgtttcattggactcacttggtcaccctcttcctctcaaaattctcactctctccttgaaatttctacactcctcatttcccctaatctctccacctatttgttccttttctatctctcaagagatcctgttcctctgtttgcccattaaactttgatatgtaggcactcaacgtatattagctgaatgagaaaataactcctaagtattttttttctcctcaaacctcagaatttattatttccttgtggaaggaatgttagctttccaagctgagcatatcacagtcccttactctgtcccccatgcacagaacaccccccccacacacacacacacacaccatcatgttgcatttttaatattactcttcaataattttatcctgaatgagcatgaggggttctgaatcagaggcagatttcatttaattaccttacagtaaatattgttgctgtgcccttcctttgcccaaagacttacccctagggcaacatgatgaacgctgatgaaacattttcctacttgagtggctgggtactccataagtgggagactaggaaaaatcattttttctgcttataaaggagaaggaggctgctatccatctctcattctgaaaggttctctgtggaaacataacaggcctgagtcctaattccagcttctgcagaaaccagctagccctgtgtgtctcatgttttacaatctggaaatgtctccaaggtatgggcttcatattttttgaaatgtaaatacctagaaagatacccactccagtctttctaacaacatagagttcagcttaggaacctaccctgagctataaccgtttgaccctcttggatcagagaaatgaactagacaaattgctacagatctaatctccatggtgtgggaagtttctcaggaggctagagctttctgtaggtgaactgagacatccaggaaagtttatttcctcatacttagttgaattgcacccagcgtttgctcatctactcaacctagacactaagtgtcattcttgtttctttttctctcttctctccagcatctattcagtcaccaaattttcacacttcagatttttagacatttccctatcctatccctgtcatttttcctggtaccattgccctgagtcaaatcctcataatcttgcactgaattcttacaattgcctcattatctctctgattccatttctgttcttctcaaatacatactctgtatttatatcaggaagatctatttgaagcacacatattcctgtgccactcccttggttaaaaccgttcaaaggttcctgattaccttcaaggcaacacctaagcctcttagtggaccatatgtgatcatagagaggcagagcttcaaattctggtttaaaaatctaatgtatttccagatagcaatagtgtctttttcatctttggacatgccctctccttgttctttatgctctagaaacactggcctgcttgagattccgatacataccatactgcactatgtcctatgactctgcacttgcattttcctcttcttggaatgttctctagcatactcttccttgaataagtcatgttcatgcttttgaattctatgtgattactagcttctcctggaagcttttcccgattttcttccccatattgcgcaagtctatagcactgtctacattgtattgaaattatttacgtgtctgactcttctattatatgttaaatattcctaaatagaaagggctgttttgcattcaactttgtatttccagtttcaggtacaaccactgacacatggtagttcaatagagggagccattattatttttataattagtaatgtcagtattaattgcctcccttcaggtccaaacagagaaactaggcaaaatgataatttacttgaatttgggaaacttaattgtatgaaaaaaaacacaagaatacaacaactgaacacacacacacacacacacacacacacacacacacacacacaaacatggagatttcaagtgaaatatcaggagaatcagctttatatgtaagcagagtaaataactcacgtatctagcatgattttagggtacagaaatatcccattattcagaaagtacttccctatctgtaggctgaatcctaatattctacttacagaactccagtattttggttcaaacgccttccctttctctattgaattgtaaatagctgtggatgatgaatcattttgcaaagtatcagactcaggattcttttgaatggtgaacaccgctaagattttattaataaatgtgtcatacaatacagctctggaacacttctgtaacataatggcatatctgaaattcaaggaagaatactgctaatttgtttttccccagtgaaagaacagggcttaaattcagcaggcaacattgctaaaagacagagttgaaaaaagttacaaaaattaagccctagatcagggcaaatattactgttattgttaaacagttatattagcatttatgtagcatgcacttaatacttttattaataccctcacttctgagatcaaagaatctgggtcaataactctcttcaatggtgtcagagtatccgttaggttattctaggctcacggtatacctcacgatccttttagcactcgattatgtgtgaacttactgttttcactctgcttctagtgttaattttctcccttctttggatctagaaactttttgaaggcagaaactattcattttgtttttctcttgatcccctggataaaggaagattacagattaaagattaattctagatctgttcatttatagaaactagtgtccgcaattcctacatccataatagctcaaaacatttctactattctcaaagaggtcacaatggatgatgtaatgactatttttcaaaagtattgagacttttctcttagcttacctattttataccttgtcagacattttgacagaattaactggtgattgtcagttggattcattgtatactttaatatagcctaaggtcctgcaaatggcccttaaggcttcccattatgttctggatatccactatttggggtatgtttaagtcctcattagccatgctagagttttgcaatatataccttgaaactttagctgtagatttgaagtatggctgtcaggttacataaacaaagcactcttatctcaatgagagggcattaactatccagaatgctccccccatctccccagaatagctttacaaacacagcgctttcctcattaacagatagacccatatagcctttaaaaaaaatcattttataaccatcagtgtataaataaaagagatagaaattgacctgggagtttcataaacaagttctgagcacccaggattaattttgagaagaatgccacaagccaaataagcacttcttttcatctcatttcacaggccttcaagagggaattgaaaactaaagaacctgtaatcatgagtactcttgagactgtacgaatatttctgacagagcagcctttggaaggactagagaaactctaccaggagcccagaggtaattgaatgtggaactataataacatattgatagaaggatcagtggtgacggagcagcccatccattcttgctgccagggtctggatagctctcatattttcttggttaaatagaatcaattcaaattaaacatagatgctgaaaaaaaaataaggactcataaactaccatgcataaatcagtttgtgcattcataaataaacatcaaaagagattagcaatcagttattggaacatttagaaaataataaacaaagggagttatctgtgaggaggaattctattgttgcaaagactacaagttaattttccatttaagagcctgcctgaagtaaattagagcttgtggtatgcatcctaacgtttttctcctcaatagcttaagtgaatcttaaattgtcggattgatataaggtagaaactcaggaagatatactttagatgttctgggctgtatcaaaatttatgccaaagtataaaaaagccgttaatcagtaggttaccctcttgttcaactgtactctttctttcttccagtatgacctttttgacaatgtttaaaaaaaaagaatgtggcctaaaaccttgtcatattgccaatttagagctgcctcctgaggagagagcccagaatgtcactcggcttctacgaaagcaggctgaggaggtcaatactgagtgggaaaaattgaacctgcactccgctgactggcagagaaaaatagatgagacccttgaaagactccgggaacttcaagaggccacggatgagctggacctcaagctgcgccaagctgaggtgatcaagggatcctggcagcccgtgggcgatctcctcattgactctctccaagatcacctcgagaaagtcaaggtaccgtctacttctttgcttcagggccctttgagagactcaaaagagcttctaatctgaacttgagtgcagtgttatcttcccacaaagttaaagctagagaaatcagtccgtctttcacaaattcagtcttcattcacatggtattttctccaagagaagacagtgatctaattatttgtctgtcttcagttatatgaaatgaaatattaaaacagttacagggcaagaaatcactttgactttgatattaagtgattgtactaaagtctgatgtgtgtgtgtgtgtgtgtgtgtgtgtgtgtgtgtattggtgtattgcttgtgttacttagtatcagaatacagaaaaataaaacacttaatcaaaagccaggagtctaggtgttggcccttttgctaaccaaattacatgacttgggtaagttatggtttggtgaaataaggctgttaatgtgttgcccttcccttggaaggcaacatttgtaatacagtttcaagtttcattggcccactgcagaaatgagggaaaatcattatatatttggaagaccactgtctataagaccaaagttaaattcccttgtggcacaaagatggcaaatatattctgtagaaaaaaatacatatttaggagtatcattttgaaatcagcaactactcatctattgtcaaaatcacaaaaatcctcctagattaaaattcaaaagaagttaaattccctcatgcactcagcatgtttgccagcatctcagcatcctcattctagaagttgtcctcttccttggctttcatggaactgttccatccatgttcttcttcctatatttttctagattcttctcctagccacccctcaaatactgttgtgcccaagtttctaaccttagcctaattctcttttgattgtttaaaccctccctgtttgagatggcctggatggtgatgtatctacatctctagtccgcatctctcttctgatctctgaatccatgtggcattacgatcacaaatgcaactattctgaaaccaagttcatttgttctcctgttttccatttccctacttctgtcccctcttatctgaccttttttttcctgtttcctatttcagttaatgaatcatcatccaacaaattttccaggctagaaactttaggttcatccttaaacccttctgcattttcactgatggcacatgatggctcatgttacctcagaatagctcttttgtgttttctctcctcttttaaccaatgtcctttttaatccccagcatcttttacttagatgataacagtatacatctttaaatcccattcacccctctgtgtgcctggcatatctcagatactgcattttaaacatttggtgaattaatggatggatgaatggtttctttgctgatgttcctgcattacccagcttcttccaattccaatccaaactccttgcgggagaatacttgcctagagaatgaaatccaatgaataaggagattacgtggcccttttcttcctagccttgacttaccttctcagccatagctcctattctccagaccatttaatacactctgcccatatgatatatatatatatgtgatggcatatttgggaaaaaggggtgatatgggcagagtgtattgaatgtgtgtgtctgtaaagtatgtgtgtgtgtgtgtgtatatatatatatatatatatatacacacacacacatacatagttagatatatacatagtatatatacatatatacatagatatacacatatatatacacatagatatagatatagatatatctgcctttgcaaatgctgttctctctgtctggatccccctacgttgtctacttggcgaattctccttcagccctcaaggaccagccaaaatgttacctatctttgttgtctttcctgagtgtctacaacccccaactcccaccaagcagaagaaactgcttacagttggtactctcatagatcaccaagcatgctaaattgtcacacttaaatttcacatatattgtagcaacttgcttatgcatttttttttctcccagagaaagtgaagttgctaagagcaaggatcatgctgtacatctttgggctgctagcccagggccagcaacatatgaggaatctcattaggtaccttcatttattcactcaacaactgtttatgagtcattatataatgtgctggacaggtagttataaaagaaacagacttgatcattgccttcatgaagcctatggtctaatgttgaattgcatagctcttcattaaaatagtaggtaaaatttttaaaaagaaaagattaaaaatttgactctaatacttgtaaaatcccttctaccccaatgttttatgaccccatgtctaacatttaaagtaagggttaaccttgctgtgtactggaaaactaagggttttgaaatgtattacctagtattttaaaagcattaaatatgttgattttattcaaaaatatagggactaattttttgacagacttctccaaaaatgagaaataagttaggaaaatgtcccagtggaactaaattagttaatatgtcaattaaattgctcaatagataggctgtagagcagacataagggattcatttttagccatacttgtcacacaggtgcatttgtaagatactgagtatggatggagaagagaatgtgtacagcataatttaataattaaaaataactaaaagcataacagttcaagtatcagctggccttcacccaaccctatttgcggtattccttttagtttccctgtcttatctgttcttggtcttaagacaaacttcattttccataccctgattggtaaaactctcattctgatcccaatgatagcaaaacatataaacattaaacatacctttcgaaaaattatatttataacccagcacatctatctttctcagacatatatacacttaagttatggtacttatctgaatttttatgtactggtaatagtagatgtgattgggcttttgaatctgtgttgtattttatgcgtgtttcaaactatgaattacatgaattcatatatatttatctcccttcggtagctcttctttaattttgcagtggaaataaatcatttttctccactgcatcttattgacactgggtttgaaactctgaagctttgggggtagtagtttacaaagaatgagttttattaactaaaatttatttcagaaaaaaagtagaagtgtacttgaaaccactcttcccatttttccactcagcaatttaagccctcagaggattcatgctgtagggaacttttctaataaaccatggtttctctttttttattttattttattttattttattttattttattttattttttttttgcgacagtctcgctctgtcacccaggctggagtgcagtggtgctatctcggctcactgcaacctccacctcctgggctcaagcagttctccgcctcagcctcccaaatagctgggactacaggcgcccaccaccatgcccagctatttttttttttttgtattttttagtagagatggggtttcaccatgttggccaggctagtctcgaacttctgacctcaggtgatccactcaccttggcctcccaaagtggattacagcactgataactaggcagctagctagaagaacattttatatatccatatcagttcattttccttacccctagacactctatcatagtaccccccctccattctgatcttatgtgttaaataacttgttattcaagaaactaagtaatatgtgtttctgtgagatttagcattctgtaattgtattagcaaatgtggcttttggatttaaagaatgggtgaaacaacaatgactaagtccctggcctttatggaaatggcattattgctagctgatcatctgcgggtggtgaacatggtaaattaataaatggaaacacaatattaatattgactatattgctcactaagagaatctcagccttccaaacatagcttccataggaaaaaacagtagaatcaaatttaagttttaaatgcttctttacttttaaaattcatgatttatactgcttatcaaatattttaagggcaagatcatgacttttcactttactgaaaatagcaccagtgcttatttgactagacaaatattctaccttccttgtaatggggaataggaataactttttgaattactaggtgttccacatagatctgtaagtggaatatataaaggctttaataaagtagaataacttttaaacctgtagtctggatacaagatttttgttcttcaggacaatcccaaggtgaaaaggtttgtggattgttgttttctttttttttttttttttgagacagagtctcactctgtcaccaggctggagtgcagtggtgagatctcggctcgctgaacctcctgggttcaagcaattctcctgcctcagcctcctgagtagctgggactacaggcgcgcaccaccacgcccagctgatttttgtaattttagtagagacggggtttcaccatgttggccaggatggtcttgatctcttgatctcgtgatccgcccaccttggcctcccaaagtgctgggattacaggcgtgagccaccgctcccggccagattgctgttttttaatgttttgtttttgttttaataaaccatggtttctctttttttaatttttttttttttgagacagtctcactctgtcacccaggctggagtgcagtggtgctgtctcggctcactgcaacctccgcctcctgggttcaagcaattctctgcctcagcctcctgagtagctgggattacagacatgtgccaccacgcctggctaattttttttttttttttggattttttagtagagatggggtttcaccacgttggccaggctggtctcgaacttctgacctcaggtgatccgttcaccttggcctcccaaagtgctgggattacaggcgtgagccactgcgcccagactataaaccatagtttctctgtaccaaaagtggtatgtccttcttgagccaggaatatttcactgttcttagtttacctgttgactctgaacacagtttttcatacactgtaaataactctcccaggctgccatcttggaatatgcaaatctgtcgcatctatgtagttatgcatatcgcatttttgtcaaacttttaacttgcatttcttactgtgaaaagtcagggcagggattctatgagttttttctttaaagttcctacaatgaaatgttttgattaaaccttttttggcattcaaattgagattgatttaatgatgtgtgtagtaggctagaaattatgatgaagtgacgatgccatccttatttatcttcagcattcacatctaaagttttaagaagaaaactggcaaatccacctttttaggcttaccatcctcagtccctgtggctttgggtttttttgagaaatttgtcaaagaaacgctatgttagaatttgacattgaggaagccaagcatatttcctctgaatagataatgtgaaatgtgatataatgtattagaatttcatcttcactttggcaagcaagatacttgcaaccatgttcatgcaactatcttcccttattgcttttctcttcttaaccttggttctaaagttttcttcttattgtattaattttgttatgcttcccatttatatgagtcaagtcaaccttacttgatttcttatatatgagttatgtaaggaaaacttatcttttcttatagaattaggggatgaatgagcagatagaaccaacatgaacagggcgatcctaaaaatcattcaaaacatgtaagctctcccaactctgaataaacttgtgatatcttcataatgaataaggtatactgcctatagtaggaagaggaaaatttattaatgttttgtgcattgttaaagaactacaaatgaattgccgtgtggaggctttcattgttgttgttgtaaaaatgctatgtgtattaagtaagcctttgatggagaagaaaaaacaaagaaaaaatatttaatccttcataaatctgggttaaatatgaagctaattcctgttatttggagtaaccagggttttatctagtttacaaagcatgcaattgcaatgtttaaaagcatatgatttggcctttaatatctgaaaatatgtctatcaaaggccatattatagcgagtgtcactccatactttataagtacggtatatttttaatagaatgtttatgtactggtgataagagatgttactgggtttctaaaccagtactgtattaaggattttatgctattgtaagattatggattatgtgaattcatatatattgatttactttcagtagcttttcaatagaatatctagggtttaatacagcttagaaactaaagcaggaattattcatctttaaaatcctgaccaaagaagtggctggcaagatggctgaataggaacagctcaggtgcgcagcccctagtgagatcaacacagaaggtgggtgatttctgcatttccaactgcagtacccggctcatctcactgggactggttagacagtgggtgcagcccacagagggcgcagaagcacggtgggatgtcgcctcaccccggaagcacaaggggtcagggaattccctcccctagccaacagaagccgtgagggactgtgccctgaggaacggagcattccagcccagacactatgcttttcccacagcctccgcaacatgcagaccaggagattccctcgggtgcctacgccaccagggccctgggtttcaagcacaaaattgggcagctgtttgggcagacaccgagctagctgcaggcgtttttttcatatcccagcgtcacctggaacaccagcgagatagaaccattcactcccctggaaaggggactgaagtcagggagccaagtggtctagctcagtggatcccacccccaacggagcccagccagctaagatccactggcttgaaattctcgctgccagcacagcagtctgaagtggacctgggatactcaagcttagtgtggggaggggcacctgccattactgaagcttgagtaggcagttttcccctcacagtgtaaacaaagccgtcaagaagttctaactgggcggagctcaccgcagctcggcaaagccactgtagccagattgcctctctagattccttctctctgggcagggcatctctgaaagaaaggcagcagccccagtcaggggcttatagataaaactcccatctccctgggacagagcaccacggggaaggggcagctgtgggtgcagcatcagcagacttaaacgttcctgcctgctggctctgaagagagcagcagatctcccagcacagcactcgagctctgctaagggacagactgccttctcaagtggggtcctgacccccgtgcctcctgactgggagacacctcccagcaggggttgacagacaccctcatacaggagagctctggctggcatctggcaggtgcccctctgggatgaagcttccagaggaaggaacagacagcaatctttgctgttctgcagcttctgctggtgatactcaggcaaacagggtctggagtggacctccagcaaattccagcagacctgcagcagagggttcctgactgctagcatcaacatcaacaaaaaggacgtccacacaaaaaccccatctgaaggtcaccaacatcaaagaccaaaggtagataaatccacgaagatgaggaaaaaccagcacaaaaagcctgaaaattccaaaaaccggaacgcctcttctcctccaaatgatcacaactcctctccagcaagggaacaaaactggatggagaatgagtttgacgaattgacggaagtaggcttcagaaggtgggtaataacaaactcttacgagctaaaggagcgtgttctaacccaatgcaaggaagctaagaaccttaaaaaaaaggttagaggaattgctaactagaataaccagtttagagaggaacataaatgacctgaaggagctgagaaacacagcacgagaactttgtgaagcatacacaagtatcaatagccaaatcgaccaagcaaaagaaaggatatcagagactgaagatcaacttaatgaaataaagcatgaagagaagattactgaaaaaagaatgaaaaggaacaaacaaagccttcaagaaatatgggacgatgtgaaaagaccaaacctacatttgattggtgtacctgaaagtgatggggagaatggaaccaagttggaaaacactcttcaggttattatccaggagaacttccccaacctagcaagacaggccaacattcaaattcaggaaatatggagaacaccacaaagatactccttgagaagagcaacccaagacacataataatcggattcaccaaggttgaaatgaaggaaaaaatgttaagggcagccagagagaaaggtcaggctaccccaaaggaaagcccatcagactaacagcggatcatttggcagaaaccctacaagccagaagagagtgggggccaatattcaacattcttaaagaaaagaattttcaacccagaatttcatatccagccaaactaagcttcataagcaaagtagaaataaaatcctttacagacaagcaaatgctgagagattttgtcaccaccaggcctgccttacaagagcttctaatgaaggaagcactaaatatggaaaggaaaaactggtaccagccatggtaaaaacataacaaattgtaaagaccatcacactatgaagaaactgcatcaactaacgggcaaagtaaccagctagcatcataatgacaggatcaaattcacacataacaatattaaccttaaatgtaaacaggctaaatgccccaattaaaagacacagactggcaaattggataaagactcaagacccatcagtgtgctgtattcagaagacccacctcatgtgcagagacacacataggctcaaaataaagggatcgatgaatatttaccaagcagcaaatggaaagaaaaaaaaagcaggggttgcaatcctagtctcagacaaaacagactttaaaccaataaagatcaaaaaggacaaaaaaaatggtattacataatggtaaagtgatcaatgcaacaagaagagctaactatcctaaatatatatgcacccaatataggagcacccggattcataaagtaagttcttagagacctacaaagagacatagatgcccatacaataatagtgggagattttaacaccccactgtcaatattagacggatcaacgaaacagaaaattaacaaggatattcaggacttaaactcagctctggaccaagtggacttaatagacatctacagaactccccaccccaaatcaacagaatatacattattctcagcaccacatcacacttattataaaattgaccacataattggaagtaaaacactcctcagcaaatgcaaaaaaacagaaatcataagagtctctcagaccacagtacaatcaaattagaactcaggattaagaaactcactcaaaaccacacaactacatggaaactgagcaacctgctcctgaatgactgctggataaataaggaaattaaggcagaaatgaataagttctttcaaaccaatgagaataaatacacaacggaccagaatctctgggacacagctaaagcagtatttagagggaaatttacagcattaaaatccccacaggagaaagcaggaaatatctaaaattgacaccttaacatcacaattaaaagaagtagagaagcaagagcaaacaaattccaaagctagcagaagagaagaaataactacgatcagagcagaactgaaggagatagagacatgagaaatccttcaaaaaatcaatgaagccaggggctggttttttgaaaagattaacaaaatagatagactgctagccagactaataaagaagaaaagagagaagaatcagacagacacaagaaaaaatgataaaggggatattagctctcatcccacagaaatacaaactaccatcagagaatactataaacacctctacgcaaataaactagaaaatctagaagaaattgattaatttctggacacatacaccctcccaagactaaaccaggaagaaatcgaatccctgaatagaccaataacgagttctgaaattgaggcagtaattaatagcctaccaaccaaaaaaagcccaggaacagatggattcacagctgaattctaccagaggtacaaagaggagctggtaccattccttctgaaactattctaaacaataggaaaagagggactcctccctaactctttttatgaggccagcatcatcctgataccaaaacctggcagagacacaacagacaaagaaaatttcaggccaatatccctgatgaacatcaatgcgaaaatcctcaataaaatactggcaaaccgaatccagcagcacatgaaaaagcttatccagcatgatcaagttggcttcatccctgggatgccaggctggttcaacatacagaaatcaataaacataatccatcacttaaacagaaccaatgacaaaaaccacatgattatctcaatagaagcggaaaaggccttcaataaaattcaacaccccttcatgctaaaaactctcaataaattaggtactgatggaacgtatctcaaaataataagagctacttatgacaaacccacagccattatcatactgaatgggcaaaagctggaagcactccctttaaaaaccggcacaagacaaggatgccctctcccaccactcgtattcaacataatattggaagttttggccaggacaatcaggcaagggaaagaaataaagggtattcaaataggaagagaggaagtcagattgtctctgtttgcagctgacatgattgtatatttagaaaaccccatcgtctcaacccaaaatcttcttaagctgataagcaacttcagcaaagtctcaggatacaaaatcaatgtggaaaaatagtaagcattcctatacgccaataatagacaaagagagtgccaaatcatgagtgaattcccattcacaattgcttcaaagagaataaaatacctaggaatacaacttagaagggatgtgaaagacctcttcaaggagaactacaaaccactgctcaaggaaatgagagaggacaccacaaacaaatggaagaacattccatgctcatggataggaagaatcaatatcgtgaaaatggccatactgtccaaagtaatttatagattcaatgcagtctccatcaagctaccattgactttcttcacataattagaaaaactactttaaatttcatatggaaccaaaaaagagcccacatagccaagtcaatcctaagcaaaaagaacaaagctggaggcatcatgctacctgacttcaaactatactacaaggcttcagtaaccaaaacagtatggtattggtaccaaaacagatatatagaccaatggaacagaggcctcagaaataatgccacacatctacaaccatctgatctttgacaaacctgacaaaaacaagcaatggagaaaggattccctattcagtaaatggtgctgggtaaaccggctagccatctacagaaaactgaaactggaccccttccttacaccttatacaaaaattaactcaagacttaaacataaaacctaaaaccataaaaaccctagaagaaaacctaggcaataccattcaggatataggcatgggcaaagacttcacgactaaaacaccaaaagcaatggcaacaaaagccaaaattgacaaatggaatctaattaaactaaagagcttctgcacagcaaaagaaactatcatcagagtgaacaagcaacctacagaatgggagaaaatgtttgccatctattcatctgacaaagggctgatatccagaatctacaaggaacttaaacaaatttacaagaaaaaacctaatcaaaaattgggcaaaggatatgaacagacacttctcaaagtaagacatttatgcggccaacaaacatgaaaaaaagctcatcatcactggtgattagagaaatgcaaatcaaaacacaccagttacaatggcgatcattaaaaagtcaggaaacatcaggtgctggggaagatgtggagaaataggtgtgcttttacactgttggtgggagtgtaaattagttcaaccattgtggaagacagtgtggcaattcctcaaggatctagaaccagaagtaccatttgatccagcaatcccattactggttatatacccaaaggattataaatcattctactataaagacacatgcacatgtatgtttgttgcagcactgttcacaatagcaaagacttggaaccaacccaaatgctcatcaatgatagactggataaagaaaacgtggcacagatacaccatggaatactatgcagccataagaaaggatgagttcatgtccttggcagggacatggatgaagctggaagccatcaatctcagcaaactaacacaggaacagaaaaccaggcaccgcatgttctcactcgtaagtgggagttgaacaacgagagcccatggacacagggacgggaacatcacacaccggggcctgtcgaggggtgggaggttaggggagggatagcagtaagagaaatacctaatgtagatgacaggttgatgggtgcagcaaaccaccatggcatgtgtatacctatgtaacaaacctgcacgttctgcacatgtatcccagaacttaaagtataataataataaaaaaaaaatcctgaccaaattatttattcaatgtgaaattaattgtaagttagtgttgccaggagagcttattacttagttaccatgtattccctctcatctcctgctttgtttataaagctaaaagcaaattacttaggacagcaatgtcaaatcactttctttccccaaagcatctgattttagatagcgctgtgtgtgttttaaaagcccctacctcgacttaggcaaacagaaccttcgtttaccatgctattcccatcccgcctttgaaacttctgaaaaggcagagcggagtaattgtttcagacatctgcttagcatactttgaagtgcatataagttctttttcagtttcatttgaaccccagctgtcttcaccgaagtctataatcaatctgaattaagttgtcctacttctcctaataagtctcttattaagttctgcatcagcctcttagggagacttaaaagctaattcatgtagaattgccattttctactaattcacttgtcagctctccaaattccaacaaaaacaattgcaaagactattaatttggctcttcataaacaacttatgtaagtgtagtatacattggaaccaaacaaacgatttaaaacagtgggtgggaggaaatgagttgatggcattcaaaacgcttccttttttgactgttatgaaatgccttccacatcgaaagcataaagccatttatttaataagggaaacatccttctgcttttactttcatagatgagataatgactgaatgaactttgcttaaagacaggaaaaggctttagaacagttggaaaaggaacatgttctttttgtcattgaacttattttaatttggacttctttgtgttattttgatggactgtgataaaagaaggagctagaattggttattattgttattggattaaatcagagttgtacagctactcttctggtcatgggatatttaggagaacacgggtaatcaaaatgttcagctaatgagttcatctgattctactcaagaagtgtttaatcagataataaaaatttctccaaataataccatccttcctactatttgaaaacaaccatatcaacatctgatcctataatatgccaatcctgtttgctaggattttctgaaagctttgtttgtggtgggtaataactagaaatactattcctcaagagtctcgggtaataaaagattattcaaaaaacttaagtaatatactctcagtattagaggatatacaaatgcactcattcattaattcatgatatgattgaaacctatacccagagaagtctgatctcattatagagtgtgaacatttaatttatttcaaaaacaaaaattatattgagagttgtatagatggcatcttagttttcctgggaatattattatttagcaccaagctgagggagcaagaatttgtattagcttgtgtatacatgtgcatgtaccacattaactagaaacagtgctaaaatgtgagttatttatttaactgaaattccatatttcctaagaaaatggaatcacacagccaatatatatttttaattattttttgacatctaccaaagttgtgacaagaataaagttcacaattctgttactctcctaccgttcagtaaaacaggaaatgctttaagatcaaataacccaaggagttcgcttcttcctgtcatgcttgacaattacaattttcaaaatttaacagttagcattgacaccagtattatgccttacacaacctgaaattaactaagttaagtaatggcattgaataatttttcttggtaaatcagttttctgggtattatgggaacagttgtgtctgtgatactaatgtctctctcattttaatggggcctaagaaagaactttttcataataagattttttcatgttaaaataatatttttagttatagtttacacttactgcaggtttttctatttaaaagcatcttccgagagcagtgattcttaaacttatttacttcagttatcttaacagcatagaagacatagcctgacatctcccgcttccacttacctatctcctttttccatgagcatgaaatttctttgatgttcttgttttattttttaaatctcacatcaattttatggtattttccataatggattcatcatgttttaatatgaagatgctttttcttcaaattctgaagtaaggaatctttcagcacattcacctatggacatgaaagcgtaagttgagaatcacagtataaaggattgcccagtttttgcaggctttatctttttccatcaacttctgtcttttatgtacacagacaaaaagagcagacccttgctatttcaaatttatcttttgcaggttcatctgattattgtgatccaaagttccatgactagcagctcttaattttgaacatgtattatttcaagcttttgtgcatagtcacttaactaatgagttaaatggcattttaagtcaggttccatgaacgcagaccctgagaacaggggtctaggtgcctgtgatttatagagggtctgctctcaggagaagcctgtattggagttagggaaacaatacaggagaagaaagagcccagcaagtatgccatttcaggtgaaacctcacattgtgtctgatccagagagagagcaagccctcgagcagaaacctcgctgtggagttgtactctttattttattttatttttttgagatggagtttcgctcttgttgcccaggctggagtgcaatctcagctcactgcaacctccgcctcccaggttcaagtgattctcctgcctcagcctcctgagtagctgggattacaggcatgcaccgccacgcctggctaatttttgtgtttttagtagagatggggtttcaccatgttagtcaggctggtcttgaactcctgacctcaggtgatctgcccacctcagcctcccaaagtgctgggattacaggcgtaagccacaacaccgagccggagttgtgcctttataccagtcattgtctgtgtcactgaagtgctggcaaatatttgtcgactagctctgaggtgggatgaatcctggtgtgtatcaaaaccagttttcgtggtgtaaatactccctctaccactgatctccagctaccgacataatgccactgagtatggaattgggaggagatgcacacaattggctcttgggctctgctgcagcacaccactggctgtggtccactcctgggatatgggttacttcctgggctagggggctcccataagcagaggtcacatgtggagaaggcaggtagctataagacattaatagtcaaccatcacagcagctgaaggatggatgcccaggttaggtaaagtgtcccctgcaactaataagtaaacctagtaatccactcactcttcatattcaacttggctttttttaatgctgttttgtttttgcatgtacagtaattctttataaataatgagaattttgtttctttatggaaaatccacctaccctccaccctaccatgaatagcttgatagctgttcatcagaattagtgatggaagagaagagttaatgaatgaaaaagtctaagaaagtgatcactattagtaagaaaatggcctcataagtgagtttggctttatagttatggaatctgtaaatgtctaggcattcagacatgtccagacatcattgagaatgtcaagaattttcagtggcaatggttctcacctcagcatacatcagaatcacctggagggcttgtagaaactcaggttggtgaaccccttccccagagttcctgattcaaaatgtctggggcaaggctaagaagtcccaacttgttcccaggtgttcatgatgctgctggttcagagatacattctgagaaccaatattccatagtaaagctactgtgtatgtacctgaagacatattttgtgtagtgttagcgtttcttcaattacaagtaataaatatatcatttattatttcttttatatttatcaatatccagaagatttagtttaaaaatgaatgcaggcacacagcctcttgttggattgattaatagtttagatatgggagcatcatagggagcattgtttcgcttaggaaccttgaaatgaataaatggcttcttttctaaatctcacttgtggaagactttgacggtggtttatttcattttttcctgttggtattttaatgacactggtacaattttggggttgcttcagatgaccaacagcataacttgccttcccagtattaatttttaacgttaaaaatatttagtcatggccggccgtggtggctcacgcctgtaatcccagcactttgggaggccgaggtgggtgggttgcatgagctcaggagtttaagaccagcctggacaacatagtgaaacctcgtttggacaaaaaatacaaaaattaaccaggtgtggtggcatgtgtctgtagtcccagctacccgaaaggctggggcaggaggactgtttgagcacaggaggttgaggctgcagtgtgccctgttcactccactgtactccaggctgagtgacaaagcaagaccttgtctcaaactatatatatatttagtcacataacttttcactttgtgtaaatattttttgcatttaccaataaaaacaattacatttaaaaattctccttacacttttctaccaaacatactgatgataaaatagtactttatagagtttctgaatctaggatattaaaaatagttgggatcagtcaacactttttaagtaaaatctacttgctagatatgaatagctaacagcttctccaggagtgcctacattttataacttactttgtccaccccttgaggctctgtgttcagggggagggtatatttttgtgtatagaaatagagatgaggtgaaatagagatgaaatagagatgatgtgggatcaactgggagaaagtagaaaagagtcttagctgaagtggttgaggaaggaggatttttcccaaaatggtgcaaaaaacaatgtattaaatatctgtgaaaaagttcatggttgtggtatagggtgagtggtatatgaaaagagaattatgggataaactaatggaaacagatgtcttaaaatttgcttttaactttaaacaagagacatgaaacttaaacttttcccttatcctagaatctgggagaggagaaggatgagaaaaaatgaaattttacattagaagcaatttgattaatgttcaatggaaaatggaaatagctatggtcaaacccactcaaatcaagtgtacattaaataattgagttaactgaattaggcagagtaagggcacattgattttcagtgttgttgaaaattggtccacatatcattgttatgctttttgtttgtaaacctcaatatttattaagtttccacagtgtgctcagccctgaaacgccaaattctcttaaccagaatgaggctggaggatctaacactaagacagatttctattttcttttaaggaattgatttttatggtaattttttttcttcataaagttaagaacctgccagtcctgtttcgaaacacacttatttttagaagtttggttttccgggattatgcatcattatagactcaaatgactcatttagaacttttccctatcaaatattcacattctatcatcatgatcttaacacggcataagcaagttagtgaacagagtgaagtcaatttattggcaatatatgccgaagtacaggaattaagtagaaacaaaagtgaatgagagtctttggcaatacattgatgtgttttttttagaaccaatgataaactactgctgagtttcctttcatttacttttttcctactcttaaaacattgtaacccattttgagatctatccattgttgtgaacctaaagcctattaggtcttattaaataatacccatttaactgacctgtgatttaagtttcttatctgcccccaagcaagcagactgtatgcaacggcattttacctgcttcaccttctgcttgccagttggtttttggtcttcacatgtttctagcagggatggggctaaagcaagggagagaatggtccattgttttagactttcacaaacccaatatactagaatctccacaaaggttatccaatatcagggtgacttttgtgcatccaataaagcataaggttaaaagaaatacaggctaaacaaatgagcataaattactccgttggcttatgctgtgaataaaatattacctttggaaccatctcaattttttttttgtataaaggttgaaggaagacatttgcaaagtcgtttctcctataaaactgcctagggtttggggttgattgttgtatgcaagaggggtcttggtgaaatctgacccactttgaatctaaaattactgaattattagtgaaaagattattttaaaaagagttttgaactctttttcctactgaaattgtattctcctttagataatcaatgcagcatcacccccacagatttttgagggcactaaatcatactcctattttgaaaaagaaaaaagtctattactattaaatatatctgttagttgaatatcaatcactttttctaaagggtagatttggccaatgagtgatttttttttttttttttttttggaaatcacatctgagaacgttgtttagacagcttgacacttagactcatttgtgtaagtagtaatttattcatcatttgcatgtacttaactggacattatcatgatagcagttgtcataacagactattacaggatatgaatttagatattaccttaagatgtgatcataaaaatcagaataatatcttgaaaatatcaattttatggtgagaaaaatgacaaactgaataaactcttgactcaagaagctagacttttcacaacctcatgtattcacagaagtaaaaataacaactaataatgtgtccagagggcccacattgctcagaaatgaatacataagactttcttttcagcctcagaatatgatgaaaagaagatgaaccattatgatgttgcatagattttaatgaagaaaattcgttttctgttcctttcgtttgactttaagtagttgaacatcctgcttttttattttgtttgcaagaaataagaccattttagaaaggctaaaaacattaattacatttaggaactacaataatctgaaagtaaaattggatattaaaggacgtttttgcaatcctttttagccctcttctgtgtattatttttatcactgctcttaaaaatttgtattaatctttggttcatttctgccttagtatttctaagttaataatatattgaatgaaaaatcaaatcagtaaaaatccattttgtttcagtagtgagtgccttccccctagaaccaaaactaaataaatgtgctccatataaagcaaaccaggtacagcatattgcacgggtaactcacaattctagattcctctattaatcattattcagacatgcagaggtagcttaatttgctttaataagtgaaaacagaatctctttgagactgctatctgcaatattatactttgtcctgcattttcttggtcaaaaattgtattttatagccatgatatattttggcttggaatttgcttctttataagcctagttattaatagtcatcatttaaatgaaatgatatccattagccttaagctgcatgattacagagacttggtctatcttacgctgtatttccagtgcctagaacattccctggcatataataggtacccaataatagtttttggaataaatgaataaacaaatttgtgcaaaagcatagggcaaaatgctatcttttagatagcgtgacccttaaaaattattttgcaaataatttgctccatttgccaccagcttatttctggccattgttacttcttgtctctgcatacaaacactctgtgtctcttctcctttccacaatgaccacaagttatactgatctacttgagattttccaggtgactatttcatgtccagaggaacatgcctcttctagtgttcccctctgtgaatgatttcagtcaccttatctactcaggaggtctctcttcccctccatcagcatctttctctgcaccttccaaacccctatgactcaacttctcataatatggattgcattttttttaatgacccattaaattgtgtacctctgctaatgattgtgagtgtgttgagacttccatttttccagtggatgataggtatataatatatatatatatacacacacacacacacacacacacacacacacacacacacatatatgtgggcacagtatctagtggatataaagtaagtgttttcaagtgagtagtaattaaatctaagagttgccgagaaaatgccattcccgttttgtggacatcttcattctacattgtaaaggccacctcattcaagacccaccacaatcttgatcccagaaaacacccatgattcatcttttacagctgccctgtacttcatattttaagttattaaaggctatttgcttttcctcagacacacattaaactttcctacctcttaccctttgttcaagttctgaacacatatctttcttccccacactatgcttcctctttatcagtttcatgtacctactttccaatgtctagttcgaggagacgtttataaggctacatgatagaggttgcccctggggcgatgtgagaaatcagctccaaaaaggtagctacccggcaaaggatcttagtctgtgactctctcatggatgaacttattacctactgctttgcagagtctccctggactagcctgaataggaacttgtgtgactatatgtgaactaaaagaaggagaaatatgcctaaacttctcatccatctttgtaacagccctaaagtatgcatgttactatcccttttctacacaagtggaaaatatttgtaaatgaacttcgttacagtctaatatttgatgacttcttagttcatatcattatttaagtaacttttctttagtggaaaagcccaaaaattagggaggcagggagagagagagagagagagagagggatcatctgtaatctcagccccagcatctataatcccaatccctgcaagggcctctttgggcaaagaagaaaaaggcactgtgtttttgaagagatccccggtcctatgccaagcctaaccaatttggtagtagagcccaggctggatttcagttggtttgtagtcttctagtcttttcatatgtaaatatttttaatgcttttattcagtgttgttaaaatgccctccaaaagatgcactaacttgtgccaccaccaccaagcagaatatattttccttgaataggctacttcctctttttttcccactcactccatttttattttaaaaatccctggtagagaccaaaaactgaaatgttatattcttgcccaaagaatgagagatgcttcagaaattagcaaatgctccaatataaatcaagtgatagatataaataattcagatatgggataaggaaaatgggtagctttctcttatttaggaactctatgtcaggtttctgtgagaaactgtttacgaagcagtctgacaatagctattggtctgaagtattagtaattagtacagaagtgcctaattctcttgactgcttgttctttaataaaaatgtattgagggattatcatgtactatggcttggcatatactggtgaaaaacaataatgtaggattgccttaataaattttctggtcttgggaaggaacagacaatgaataaatgaataggcaaatatatatgtacttgcaaattgtgatcagggttcagaaggaaaatagggtgttgagagtcaaggaaaaaggagacactttacgtagggcaaccaactgggaataggctatctttaaaagtcacatctaactgagatcagaagtatatgaataagagccagctaggcataaagtggatatataaaactccaagcagagggaacagtgtatctgaaggttctaagtcaagagtaagcttgggccaggcacggtggctcatgcttgtaatcccaacactttgggaggccgaagtgggaggatcacttgagcccaggagtttgagaccagcctggaaaacatagagagatcccatctcgcaaaaaaaaaaaaaaaaaagaaaaagaaaaaactaacttaaaaatatatatatatcaatgccagtggtgtgtgcttgtagtcctggctaacttgggaggctgaagcaggaggatcgcttgagcccaggagtttgaggctgcagtgagctatgatcgcactgctgcactccagcctgggcgacagaaagaggccctgtctgaaaaataaaataaaaataaataaagaaataaaaagcttgatgagttctaggaactcaacattttctaacttcttattagaaatgccaaattctcaggcccaccttacacccactgaatcaaaagcactaagtgggactcagcagtctctgtgttaacaagccttccacatgacaatgagatgcacactattgtgtgagaatcactgccttagactgatgttttgagctatttaggggagggagagggcccattcagggacaatggtggttaacacatgtggctcagaccaagaaatgattgcaagcccaaaaacttgttaaatgtaaaacttcaggcgcagtggctcacgcctgtaatcccagcactttgggaggccgaggcgggtggatcatctgatgtcaggagttcaagaccagcctggccaacaaggtgaaacccagtctctagtaaaaatagaaaaattagccaggcatggtggtggtgtgcgcctgtaatcccagctacttgggaggttgaagcaggagaatcgcttgaacccacgaggcggaggttgcagtgagcccagatcgcaccattgcactccagccggggcgacaagagcaaaactctatctcaaaaaaaaagtaaaacttcatctgtctgaagtaacttctgaatttgaagataaacatcctcatggttgatattttaatggtttatggattattacttacttttaaggaagttaataggtttcattaactgccattttgcttcattttgtcacatataattaaaatttttcagacagaaaatattggtattttttctgtttccttagcaacctaaagcatgacctgcttaaatgacttatttgtgctcattaaaagcctttttgtgttaattgtgtatattttgtatttagcctctgtgaaacactcatgaactatctttttatttgttttaattgtgtcattggaaagcttgaagtattttgtggtttttttttttttttttttttttttgcttgttttttgtctataaaggggagataactggcagttgcagttaggattatagaaacattttcccaaggaaattaataaaatttgttcaagtttcttcttttacaaattgtacttatttttgattttttaaatagtggtaaaatacaaattacatgaagtttactatcttggctctatttaaatgtatacttccatggcattacatacatttacgttgttctgctgccatcaccaccatccatctccagaactcttctcatcttgcaaaactgaaactctatgtctattcaacgataatccccaccaggcatggtggctcacacctgtaatctcaacactttgggaggccaaggcaggcggatcacctgaggccaggagttcgagaccagcctggccaacatggtaaaaccccatctctactaaaaatacaaaaattagctgggcgtggtggtgcacacctgtaatcccagctacttgggaggctgaggcagcagaattgcttgaacctgggaggcggaggttgcagtgagctgagatcgagatcacaccactgcactccagcctgggcaacagagcgagactccatctcaaaaggaacaaaaaagaaaaaaccacagtaattccccattgcttcctgcccccagcccctggaaaccaccattctatttcctgtctataaatctgaatactcatttctatatcttctttggagaaatgtctattcaggttacttgctcattttttagtcaggtgatttgttttcttgctattgagttgtaggagttccttgtgtattttgaatactgaccccttaccgggtgtatggtttgcaaaatatcaattgctcctgctatgttcaacttgttcttaaaaataaaaacttttcctttgtggtcaatacttccctgttcctcatttccaaattttatacatgaaggaaatgtgagcacccagaaaagaaagaagatagacactgttaatatggccaagatataattcggcttttattataagaacattggagttacaagcttcatagaaagccatgtcctaaaagatgaagaattatgatcagtgcaaagagaaaatgttaaaaagaaaaagttatccttttatgtttgggtatatattctttttcgatattgtaaagagaaactagagttttttgttcttgtttttgagacagagttttgctcttgttgcccaggctggagtgcaatgttgcaatctcagctcactgcaacctccacctcccgggttcaagcaattctcctgcctcagcctccagagtggctgggattacaggtgtgcaccaccatgcccggctaatttttctgtttttagtagagacagggtttcactgtgttggccaggctcgtctgtaactcctgacctcaggtgatccacccacctcagcctcccaaagtgctaggattacaggcgtgagccaccgcacctggttgagattgttttttataaaaagatgtggattctttatggaaaacacagagcagttaattgctatttttttaatgtcacaaatttggaagcgtgttgagtctgagaagaaaccatagttaaaatataattactgataatcgcttgggaaataaaagccctaaatttcttcatgcctacaaacttaatattgttttcccaagatcttttttttgactttaacctttcttaagtgtttctgattatgctaaatctaggccattagttctgagtctgtttcattatttatattgttattcagtttactcgtcaaaagtgatcatgcccaaatatgaaagtttacaagaattgccctgaaaactgaacggaaggagacaacgaaaagaaactgcataatattttgccttcaggctatcacaataaaaactgttgctggaaaaaaatgcaatcacatcccttttttttttttaaagtacgtttcaatggcataatttattgtcgagaatgtctctaccagaagcataagtgatactaaaggcagagggttgtattcgctcagtctgcaaagtatcccctttgtcttagctccacacagtccctcagaatttggcagaaatgagggactcaactttcgagaaagggtgacaatcccagttttgttggagagctatgaaatagccccatagtgttagtaatgaaaattcacttaagaagtctcctgcaggcccggcacggtggctcaggcctgtaatcccagcactttgggaggcctacgtgggtggatcacctgaggtcaagagttcaagaccagcctggccaacatggtgaaaccccatctcttctaaaaatacaaaattagccaggcgtggtggcgggcacctgtaatcccagctactcaggaggctgaggcaggagaatcacttgaacccaggaggtagaagttgcagtgagccgagatcgtgccattgtactccagcctgggcagcaagagtgaaactccaccttggaaaaaaaaaaaaaaaaaggaaagaaaggaaggaaaggaaggaaggaaggaaggaaagaaaaaagagaaagaagtctcttgaaaaaaagaaaggaagaaagaaagaaagaaagaagtctcctgtataaaaaaaggaaagaaagaaaagaaggaaggaaggaagaaaagaaaagaaaagtctcctgaaaaaaaaaaaaaaacaaaatataagtgcttgacaactgaagttcaagggtaaaggctattgggaaagcagatgaagttaatctaagtaatggatgctgttggtgccccagtcagattcgttcactgggttggtgcacccattcctcagtgactctgagtattagctgctaaagcctcatggtttcacccctttccagagaacctccctcagccaaaaggaagccaccttgactggcatgtcccaccacaccttctctcttaaaaccaccaggggtacaaagggaaaacccctttgcctcatcatggcacctgctgttgtacaatttgtgatctgggaattcccatggggccagattgatgctggtctccagcccataccacatcccaacttaactttcttgccctgtcttcctgcttctctcactccctttttcttaagagcactcagactctgcttctcttaaacctggctgaaggcagtaggtatctgaaagaaaagctgtacctacattctgggcatcagagcagtcagggaaccaaccagaatgaaaagtcaaaaattacagataatgatggaagtctctgagcctgatacatttcatgaagggcttgcttacagctcaacttgtgtttctttttaattgtttcaacagcatttgagtagctcattccgcccaggtatttgagagattccagtaggcctctgatcctctggaaaaagcaagatacagtccttgactctcttggccccatgaggatgatatatctgctgagaaatgcaggagctgcaaaacatagctgggctgtacctgctgccaattcccgggtaattgcattctgtgagggcttccctgaaccacgaggaagagccccggaataagtactaaacaccagtatttataggacatgatttctaattgctcatccttgccttctcatgactagctcagcatgaagaatgctgggacttttctttcctagcacctcctctttttaggctgttttccaagagtcttggttaacaaacatttgtttgacaaggattcatggtagacagcaatgccattagtccctacttaagtaatatttgtaacataaatttctctgcacgtgtatgtagcccaagaataacacttcatttttggaacctagtaattttgaattcctagtaagtgagataggacgtctatgagttagcaggttaagattttaggaggaatatttaatatccctaagaagggaagtttttcaaacactgagtagcactatatatatttatatatatatagccagatttctatctatctatctatctatatatatatatatatatatatatatatatatatcacaccatttataaataaactcataagtggcaaatccagtagagctaatctgagcatcccagagtctcccctctctgtcgcttgtttgtgcagctactcctgctgtggccttttatggattatcctggacttctacaactgacccctctactttctctccatctacaagcttcattttgctttgctttcctcctaatccagtttagattccacagtatattttttcaattacatcctggctaatatcgaaactcccttatccctaaatgtgtgagccacagtcatctgacgaaaccccaaacctggatcaactgttttccccatgcttacatgcaacactgttggagaaaatgagaaagtcaggcagattggttctgctaaaaaatgttgaacctcatcctcaagtgggccctcaacactgtttgccaacctcattacatctcttaggtcaactccctctcacagtctctattacgattaattcaaatgttcccacttacccttaattcatgttttcattcagtgactattcattgcacaccaggcactgcacgctatgccaggcactgcagactatgccaggtctgttgattcctacttcacagaggaaataaaacccctccaagcagaattccctcaatttactctttctagtctttccaactgaccttctgtgctttgcagtaggaatgttctcttaactgtcaagtcaaaattcctccctcaaaaataagattcccttgttaatagacaattcctttattttcttagaaaagtagtagatgactataattttaaatgtgtatttgaacaaatccttagctacataaagataagcaaagatatgacaggcaatttaattttatatgaagaaaaacttattatatcagacttacctatcattctaaatcagtacttttgtatctataatcagacaacatttaatgaactgaaaattctgcctgtgagaaactagtcataataaaattagacttggtttgctctttcatggagaacatattccagatgtttaagtgattcaaagaaaacccacaatataatggctttcttcaatgttttctcacttactgcttccaaactagaaaaaaaacctaatgcaatcctgatatcacttaaatagcacctcgtattgctcagcgttaactgtgctttttgacattttaggtgtagtgtttaataatttaaacacaaatttatgtgtgtcatattaaaagctctaatctgtgaaatatagccaaaccaatgtcacatctatttaaatagcaaagtacctgtgttcaccctttacagggtgaaggtcttgtgactctgtgtttaggcggccatacttcttgttatgtatgctgctgggcactgagagcccacagtggtgagccatccttgggtggtaaaagctgctaccaaaacctaaatcaaatgccaaagtgaagactgacatgagcattctcctgcctccttttcctttttatctttcctaccatctgttatctcctttcttccaccttcatgcgttgagtgccctcatgatgatttctagctgactgaagtcctttagtctgctcaaccccatctagagacttccccaaagtgaacctttgcccccagttatctgtttatcaactgacctcacaccagtcaaagcttccattgtcaaatattttaacagaaatttaggaattcagattaaactgaatatttggcattttttcttttttttttttttttttttttggagacagagtcttgctgggtcacccaggctggagtgagtgcagtggtgccatcttggctcactgcaacctccacctcccaggttcaagcgcttctcatgcctcagccccctgagtagctggtactacaggcatgtgccaccacgcccgaataatttttgtatctttagtagagacagggtttcaccatgttggccagtctggtctcgaactgctgacctcaagtgatccacccatccacccacctcagcctcccaaagtgctgggattacagtcttgagccaccccacctggtctgggttgttttcttcatctttagcagttgtcttgttcacaactacttcaacaatatttattttctttttctttttgaagcaactctccagagtatttggcctggtttttatagaaataataacttttttcttttctttttaaactaatatttttatgatttaggaaatctttctttattaaattacataatcacaacagttactggcaaagataggtttgagaacatacacacaactgacggttgtaacaagtcaactgatgggagcagaaggtccacacatactgacaggcacctcgaacattttattgaggctgtgagaggttcccatcactgctgtttcacaaagagaatgaagactttggctaatttggtgagtcttaagtggagattagttcagagaacttccactatcattgcttgaaagaagcaaaaaaaaaaaaaaaaaaaaaaaaaatcccaagatcttatggtaaagtttaaagaagaaaagtaaattttaaaaagaaaaaaaaagaggaaaagggagagcattgcaattaattatgagtaccaaaacttatttttgaatccccttcatcctccaaaacattgaagcaggattaatatgtgtgctcaggaatttgggagagaaaatgaaaatcaaaatattctaataagagacatttgaaaatgtacattgtgtcacctaaagggaactgaaatctagctatggcttaacgaggtaggataatcaacttaatggcttgagagtcttgcttgtaaagagagatgattagcacaaaggactcacctgtatcactgaaagatgctgcctgctggcttgccctctctgcagaggttcctgtttacagtttcccctcacatgatatttatttgtggctactagaaatgcacgttattatccagaagagaatgatttcattttgtaaccgttgtccttgtccaagtttcccccattgacatttaagaaatctgttttctaacctttctattatgcaaaacaaaattaatatggatcatttccttttagagataagtattcatatatatggatttaaaccacctttctccatgggcccttattctgatacttttaatccatgtatttattcataaggaaatggaacaatatttactatccacccctataaaactttctgaatttcacactgattccagtgacattccactaacacgaagttgaatacagatgaatacatcacatatgattttttttttgcatgtgtatggtcagaaggggctctcttttgtttgtttttattaatatataattcacatactttaaaattcactctttcaaagtgtacaattcagtggtgtttagtatattcacaagattgtgccaccatcaccattgtttaataccagaacattttcgttatcgtccaaaagaaaccccctgattgcttaacgtaatgtttttaatgaccactttttaaaactttaagttcaacagagtgattatcacaatgttttgtattatctaagaactacacaacagtgttatgctctatacagcaccacggtttactgatgaagtattcaggttgatttgagaggataatgtcgttcttattttgaatgttcatactggctccttttatttggagtgggaggaaatgcaaggcttataaatgaggtcagtgtaaccaatggttttatcaacatagtgaaccagacagagaaataacacctgcccagatcaagcaagtcaaaacaacacgtatagtcaagtggtgctgtccttgtacacagacattacattacacaaactgttctcctaagtgagggaatttgtcccttagaaattgcttattggaacatttggacatcatgcatcatgttaaagatccataaatgccatctcgatagggtagatatgaggcgtggtaatatcctccccatatctgcatagggttcttctgctcaacggattgctatgatgtattgcatcagagactcctgctctagtgcttcaaagacagctgagaagccccacgggagccttctgaagtcattgctacaagggctaaaataccaggagatcaggaagtcattctgaggacttgacaaaataccctactccctaaatgaaactgttatgatgtggttggtgcaaagtatgcatgcaatattttatgactgaatatatctttctattgtaaaaaataaggatccatttctggttgtgacatgagtagaatttagaatccagcagcaatatatttttcttgttactttgccaatccagaatttcttaggggaagcatataacataatagttaagaatatatattctagaggcaggcaaacctgcatataggtatcccaggttcctcaatttttacccatgagagcttggcaaggtttgtttgttttgaaaacaaacctctgcaagtttgttttctcatgtataaaattagaattctccaactactggcctcataggattgttgggtagaaataaaatcagtttatgtatgaatagagctcatcatggcattaggcacctaggaagtgctcaacaaatagtagttatcattattcccccattaacaaatatccattgttataatactaccacaagagactgtcttagtctgttccagctgctataatagaaatgccataaattggatagcttgtgaaacaacaaaaacttatttctcactgttctggaggttgagaagtccaagatcaaaataccagcagatttggtgtctggggaaggcccattcctcatacaaagcaccttctcactgcaccctcacatgctgaaaggagctagctagctctctgaggtctcttttataagggcgctaatcccaaaaatcacctccctaaaggccccatctcctaataccattgccttaggtgttttgatttcgtttcctttttattttttaggatttcaacataggaatttgaggggggacacaaacattcaaaccgtagcatagagcaaacattactggcactgcaccctaaagagaataagcccaggtatcagttcttcttgttttaaatattctcatcttccaatttgcttttgactattgcacacaggcacttcgaggagaaattgcgcctctgaaagagaacgtgagccacgtcaatgaccttgctcgccagcttaccactttgggcattcagctctcaccgtataacctcagcactctggaagacctgaacaccagatggaagcttctgcaggtaagcacattgtaaacattgttgtcctttgttacagtaaaataatatacagataaaatttgtaaagaacaatgaaagtacttttttcatgtaatgttcatggtaatatttgtgaggataggatattttatattagtttataattcccatctaaacattttcaaattattaatattaattttggaagcaactaagacttagtatatgtcttagtctgtttagtgttgctataaaagaatacttggggctgggtaattcataaagaacaggtgtttatttggctcagttctgcaggctgtacaagaagcatctgcttctggcgagggcgtcaggctgcttccactcatggcagaaggcaaaggggagctggtgtacaaagatcacacggcaagagaggaggagaaaaagagggaggggaggtgccagttctcatgaaaactgctagagcaaaacctcgctcactaccgtgagaatggcaccaaaccattcatgagggattcactcctacaacccagacaccttccactaggcctcaccaccaacacgggggatcagatttcaacacgcgagttagagggaacatccaaactctgtgtagcagtattcttacgataaacagaaaataatgctgaatcatgatggaagatgtgaattgccaccatgcagttcctttgtactcttactgcttggattctcaaaaacatctttccctttagaatcctaatttaaacaagagtcaatagtaagatgtgtccaaaagtcatttaaagaaagagcatcctatcacaaacttacatgtggaagtttttcgtaggtttgcgtaataaatacaggcaatgtaagtgtgctgctcaaggtcacacttactagccatgggacctggagcaaattacttaacctttctgagcctcagtctttcatcaaaaaaaaaaaaatgcgataataaaattctctgcaatatcagtttattattaggatgaataagtcaaaataaatggaaagtgctcgggagcgaacatgccaaatgataaacactctacaaattctagctcttgatgttgttattattattattattacagtacacaggttttggaatccaacatattagctgagtgaccttgaggccacttaatctctgtggttgtccatttactcatctctaacatggttactgtaacatcgaatgagttaattcatgcagagtaatggttgtagtggtggaagaggtgcgtctaccttctcagtgtgaaggacaccatgttataccccaaaaccctaaaattagtttaaccgtagaattagagaatcattttctctcctttccaattttctcctttccaacaggatgcagaaggtatgcctctgaggaaactgggtttaaaactatttggttttaactttttaataagaaaaatataataaaccaaatcactttcctattgtcagtccatttaggggtgtgattgagaggcctgttaaagaattgctagatctttaataaagataagttgcaaatcccagacctcttgagatctcacataatttaattcttgttgtgatggatagtcctgaaagatttgtattctagattgttataagtggcatcgactaaagcaaggcgatatagctaagtgattatatgcctttctctgtttgctccatagtagttgagtactattaaaattttatctgttccatccttagtatgtttttcatcttaagtataaataaggaaagtaataaatgtccaaagaaaaccaatggccacattagtcccatataagtgttctagaagtatattttataatttcttttagagagcagaatgccacgtttgctttcagaacgtggtaaaagatttgtgacagtggcaggtagatttccaaatgaggtcaaaggattatgactagtaagaaaagtttttttttttttaatcaatgctaagtgatccattctagttgcactatttatttgcatttaaggtatcaaaaacagtaaatagcttactatgtagccattctttacaatgagtaaaaacttggttataagtacaggaaaacacatgtaaggagatagtatgatatagcgaaaagagcattggattgactattaggaggtctaacttcaaacttaagctcagccattatttgaccgtgttattgtgagaaagccatttaacctctctcagctttaattctcctcatttttaaaatgcagaaatctattttgtctaaggtcacatacagttcaatcttatgattctgtctctagatatctgggggagatacacatttgacagaatttagtttaaaaccaatgaagttcctttctttattcataatacaaatgtggtttgttgaaattatatttctccttgtataactctaacttttaatctcttcttccctaaacccacatatacacagccttctcctattaaacagttcagtttgtggtgtctgctctatattgtagcaaatttcatgtttctatttttgaacatgaccttaaagatatgcttaaaaagtgtttttagcagaaagctgataaatccaaggttttggtttgcatataaccgagtcaagttagttccattcttttctttgatagtaattctgctacattataaatgtgaggccttgttcagaaagagaagaaagcaagaaatgaggttcacatcaagcaatttttttcccattactggaaaagcaattcatacatcctgttgagaatattttatatttagaacaatgtatgtgaggctaacgcattatccaagttctatggcgggaagcttgagcccaccaccattatgacatcatatttttttaaatagtaaatgtcaaaaaagacatatttctatgaaaataaagaatttagtcacaatgctatgtcaatctttaaatcgtgataaaaaccaagtacaagttcatctttgcctctgtccactaagacaaagaacaatcaaaaagtaaagaactctctgggcatggtggctcacgcctgtaatcccagcactttgggaggccgaggcaggcggatcacttgaggtcaggagtttgacaccagcctgaccagcatggtgaaacctcatctctactaaaaatacaaaacttacctgggtgtggtggtgcgtgcctgtaatcctagctactctggaggctgaggcaggagaattgcttgaaaccaggaggcagaggttgcagtgagctgagatcgtgccactgcactccagcctgggcgacagagccagactcggtctcaaaaataaaataaaataaaataaaaatagagaactggagtagtagaaaggcagatgtaaacctgagaaaagaagaagagtcttaaatttgggcaaaatagtataatagaaagattagagttacatactatcaggccgtgtctacttgatatcagaatatcctgggttctttgcattatccattcatttaattttcaaggaaagccatgctagttttttagctgtctgtaatatcagtcaaaatggtgaaaccagttaagggatgtgagcaccaacaatacagtcaaacccagtcacaatttacctatgtatagaatcataatgtatagagaattccaaactgactttgaatcttctaatagaaatgtaagagacattggtttgcctgtttgaaattttctgtgggaatgaagtcctattttcttcctcaaagtagacacattggtatgcatgttactatttgaccatttgactttttgtggtgtaggaaaccatcactccttgcagttagaaaaagtcctcatgtgcattctctcatctaagaatcacaaccttgtgattttgtattatgattatgattacctattatcattattcccttttacgtgtaaggaaaccgaggcttagaaacatgaagtaccacagtcacagtcacataacttgtatcagtcaagatctgagtcaggtttttcgaactgctattcccatgctctttttgtctcctcttctcaaaatcctattacgtttggacttaacaaagcaataatggctgggtgtggtggctcacgcctgtaatcccagtactttgggagggtgaggcgggtggatcacttgagatcaggagttcaagaccggcctggccaacacatagtgaaaccccatcactactaaaaatacaaaaattagctgggtgtggtggcgcacgcttgtagatcagctacttgggaagctgaggcaggagaatcgcttgaacccgggaggcggatgttgcagtaagctgagatcatgccactgcactccagcctgggcaacagagcaagacaccatttccaaaaaaaaaaaaaaaaagcaatactttaaaactattttggacaatacaggtgtaaaatacttcacttttttacatgtatcttcttttttgaaatgattcttaggtatattaacttttaaatcttccttttataaaccaatggattaatgaacccagttcagtgtaccccttagaaatcacacttgtttcaaatataaaattttaaagcattatattcctcattgcctttagaactcagcaattgtactaaaatcagccaaaagtgatttcagtgaatcagctcttaaagccaaactaatgctaatatttgaccaagtagaaacgaatatctaaaccaggtgagaaaaaagttaaaatgatgataaacctttctaattttgaaatagtacacacactgagtaatgcagtcaatctctttattcaccaagcgcaagtagtatataaaggaatattataccatttttctttactcatgagtaaacccacaaatagcacaaaagctgcaaaaacactttaacataaggagtatttgttttattgactgtaggaactcatggaatgcaaacacctttaaaatctgaataatatgaaggcatttccagctattagattctttacatatgtcaaagaacagtatcataaattatgtatgttttttaaaggtttcctaagcttcttccaaagtcatgtagacatcattacactccatctgtatacctctgtggtaacttgctgtcgcagggatctagagcctcatcttttgcaaacttcattccttctttcatccctttgttctttcattcagtcagcactgattgagcatctactgtgtacctagaagacattgtaatgatcctgtttggtccaaggacatactaaacaaaactccctttactgcttatgctatattaagtaaagctttaaagatgggttctcttttattacttccatgatggcccacccctctcatcctttctcagtgttaaaaaccagaaatatacatacttacatactatcataacactgatactacaaaagcagtacccattattatctctggtttacaaattattcaataatttcttactggaaacttggtctatatagtcatagtagtaagctttgtgagaggatgtgatgggatcatagttagctaaacaataggagtatttgtgtggcttcattttaaaaaaactaaccagtttttttccaacaagcaattcttatatcagaaccatttatattctttactttggtgagataggattttctaagcaggtcttttatctgtatctatgtatgtttgttcttaccatcattgagcacaggatttgatcctttaaatgtgttgacagattttgaacattttcctcatatctttcttttttgttttttaatgatcctgtactaatcattttgcattatggggtcacttctggacagagagcctagccatctgctcttacaaataatgtcggcctatcactaactggggataaggagaagacatctaccgatgtctttctagcatgtccttcttgactttttctttctttaagaagactaaaatgattcagcttgtggttctaccacagaactcaggagaaaatgataaatatgaggccattctccaaataaatatgttttcctacattagtggttctcaaattttaacaagcatcaaattcacctggaaggcttattaaaacacagataactgggctccacataccaagtttcaaatgattcagtgggtctggtgtggagcttgagaatctgcatctctaacaaactttcaagtgaggctaatgctgctgaatcatggaccacactttgataacccctgttctatgttaagtacttgtcaggtacagacaaatttaaaagttaaaaaaatatatatatgacttctgtaagacactgtgaagggtttagactctggggaaattaagtataatgccatcccaaaaactctgtgttggaggagtgttcaagtgctgcaggatcatggagaaccaagcacttaacttttctatgaggcagaaagaggaagataaagggaaacgtggaggatgaagggaaactgttaatagatccccagaaacacaatttgctgctatatggatttatatttactgtatttcaaatcacatggtctagaactgtgctgtccaatatgatagctacatatggccattgagcccttcaatgtagccagtcgaaagtgagatgtgtagtaagcgtaatatatacacatgtaatatgtatatgttatatatatgatatagatgtaatatgtatgttatatatatgatatatatgtaatatgtatatgttatatatatatatatatatcaggatgcaaagacttagtaccaaaaaaagaatgtaaaatatctcattatttttatattgattacatgttgaaatgatagtatttttatgtatttgcttgggtaaaatgtcataatgaatttcactcatttattatgattattcaaacttggttatttttcttgaaaatgaatgaagtgagcctgttgcttcggctacaacaatgggcagtgtttctgcaaaatttttacatgtgcctactagaacatttaaaattgtacatgtagcactcattatatttctgttggatagcattggcctaaaagttttcaaaatctagcatggataagaatcacctgcaaagcttgttaaaccaatccgcccccagaaatttagtatcgggtgaggcctgcaattctgcatttctatcatgctcccaggagatgctgtctatttgtaaccacatatagaaattcattcccaaactacagatgatagagttttacagagaggtgcaaaaatatatttttgcatcaagcattgtctgtagcttgaatacaaaattatgttgcccatataccactggtttttgtaagtaaagcagttgtgttacaaagcatacaagtttttatcagctaatagccttttctcaattagcagatactaagtagtacttttattatgtggcaattctccagtttttggaatgttattgagaaatacacagggttaaaacaaattagaaagcacctctcccaaaatactgcagtaagatgtaggaaaaactgctctaacatattctaaactataggttgctcttatgtaaatatttcaactataatatctagtctgatgtgcccactggccagagttttgtaaaagctaaaagtaaaggaaataaaaaaaagaaagaagtatgtgtttgtttttgaaaaggttaggtcacagaaggatttgttgatattaggaatagaatgacccgtgaaaaaaggacaattaagttccaggaaaacatcttttcagtaaggagagaataatcatttatgcttaacctcaactctgttaggaaaaaaaggatgtaaacaaaaccctttaaagaattgaagaaggagagtataaatttaaatgcccaggttagtgaccacccttagagcatactgaggtcaaagcgtactgtcaagcttaagaacatttggttttcaatgtttgtacaactaattgtactttagtcaagaggactgttatcgaaattgctcaggtagccttgaaactaatatggcccaaatattccagagtctgtctttctcaccctaggagaagaatggtctggttttcaagggaattctctattttttttttttgaaggcatcaggatgtgtgaaactacagggggataaatgaacgatgtacagaatgtgatgaaaaaattatatgaagtataaaatgggaatgaagccatcaggagccaaagaaatatttatgaatttaagagaatgaaaagcatattattattttcagatattttataaagtgaacccaaatcattataaagtattaattaggctacttgattgcttgatctttatatactaatttctaatttgttttaatcgggaactatttttgctagttctaaggctagctattatggtaatccatgtaagtgtgtttattattgtttttaaaaatggaatgtgttcctagtaaatgtgtttaaatagcaaaatgtatttatgcatgcatgtatttattttagtttcctgagacctctagttccttactagaaacatgtatataattccaggcatttaaaattgccatgatggtcatgttttcttgtccttttcccttattctgcaactgacatttgcccttgtctccaatttctcactgctttattctttgttcttgtaagtgttcttgtctctctgggctgacctctctccttccctggagtttgaccccgccccaccctttcttctgcatttgtttgcactggttgttttcttcattgcctttcccactgccccgctgcgctgcatgtgaaacactccgccagtagctgctcacagttcccatgctacatcatacccagcattcaaagagctgctgttctcacatggccgccagtaagattcccgactcctccttcacagcacattcctctagaaagtagaaagaatcccctttcaggccacatgagaagctgcgtgttaaagccaactccataaaggggaatggaaactagcgtatgaaattcagaaatgctacttttaaaggtaaataccacaaagtgaatttcaaattcatacagtttatcataatacttctttatttttataaatgctataatgtccttaatataatgatcactgtgatataagttgtcctctcccttaatatattaattaatttactaaaggagacgggagggtggaaatataataaattagaagatgattcttatatcagaagtacagcctttatacatagttttactttattcagacaatcaatgtagtcatatggtataaatttgaaaataattttagtgagcattacgcttactgagattaatagtgagaacttacctagcacttactgtatgccattcacaattataagcacttttgcatgtgctaatgcttttaagcctcacgtaacccagtgagggaggtacaattttaacctcattttacaggttagaaaaatgaggagcccaagggttaagtgacttgcctgtggtcatatatcaggtaagtgagagagccaggatttgaacccagacagtctgcctggggaatctgtcagaactcctaactatgcagtaccactcctctgataaaaagttgaattgacatgacaacatttcctattcatttatgattcgaccctttaaacaaaaagaacagcatcattctcacatttattaatttgtcaggaatcacctggatcatgagttgaggaaatttaaagtaggagggttgtatgaatttcagaccacgatctcaagaattgcctgtttaactcagagcctgaatcattcacagactaaaaactagaatcactcttctgtaggaccaagagggttgaatcatcaaagtcttgctgaagtgaacggaaatcctcctttgttcaatcattcattcaataattatttttttctggtgtctactctttaccaaactctgtttgagatgatagggattcagtcatagacagaccttctctgccctcatggaggttatggtttcttgggatgacagacagtaattttttaaatctcataaaataattacaaatgtgtcaggaaagaaaatacaggacactaccagaatatatagtaaggacctaaatgtgtgtgtgtgtgtgtgtgtgtgtgtgtgtgtgtgtgtgtgtgtgtgtgtgtgtgcgcgcgcgctgcagtaagggtgagaggcaggaaagggcaatcaggacaccctcccaataaaagtgacctttgaccgagatctgaaggatgaagacaagctgagtgactcttctattcatctatatcttttgttttaaatggcctgaagcctgggactaactaaacagggttgtaaaattccagtatgtaaattgaataactagggatcatttgaagtaatggactgcagagttaatgtataattaagtcacatctagggaagatttcccatcattatcacagagagcatcctgtttgctttcttcacagcacttacgaaaatctatagctatgtgtttggtggcttgtttaatgaaagtctgtttcccctatctgaatgtgagctccataaggacagaggccctgaataccacatctactgacatttggcagtgtctttcatatagtaagcattctataaatgtcttgaatagatgaatgcataaaactaagttaaaatgttactgaaaactataaaaataagcagaaagttataccagaggagaaaaattaggggaaaaaaactataatttctgaagacgtagtacttacatctaaatttgtggcttcataaggttaaccaacacttaaatagttttgccaaaactccaagaaaaaaatgaccgggtgtcgtggctcacgcctgtgatcccagcactttgggaggtcgaggtgggtggatcacctgaggttaggagttcgagaccagcctggccaacatggtgaaaccctatctctactaaaaatacaaaaaaattagccgggcatggtggcagacacctgtaatcccagttactcggaaggctgaggcaggagaaccacttgaacataggaggcggaggttgcagtgagccgagatcatgccactgcactccagcctgggcaacagagcaagactctgtctcaaaaaaaaaaaaaagaaagaaagaaaaaaaagaactaccatttgacccagcacttccattacttggtatgtacccaaagaaatataaatttttctaccaaaaagacgtgcgctcatatgttcattgcagcactattcacaatagcaaagacataaagtcaacctaggtgcccatcaatggtggattggataaagaaaacgtggcatatatgcaccatggaatactacacagctatgaaaaagaaggaaatcatgtcctctgtagcaacatggttggaactggaggtcattatcctaagcgaattaaagcagaaacagaaaaccaaataatgcatgtgctcacttataagcaggagctaacctttgggtacacatggatgtaaagttgggaacaacaggcactagtgacaagggcaggagggtgtgggacaagggctgaaaaaactacctatcgagtactatactcactacctgggtgacaggttcaactgtactccaaacctcagtgtcacacaatatacccatgtaataaacctgcacatgtaccccttgagtctaaaataaaaattgaaatctaaaaatataaaatatcaaatcataaaaataaataagaaaacaattgaatctactgatatgtttcattgcttttaaaatatccactttgaattactgaatattttaatatttttagttttacacttcagcacagaaagtccagaaatccaacccttgagtttacaaagacaccacatgatagttcatagttcacacagctagttagttgtggaactagaacccaaaatttgctctctatgtctctcacataccttttccctttattctaataaaggcatttgtcagtctaaatgtacaatattcgaagacattttttaaaggaactacttatccaaatcccacctgtcttacaaggtccatgtgaagcaatgagataaggtctgtgaaactgcttccgaaactatcaaatgttataaaaatgttaagttttattattagaactgcagttcatctctatgaaacctttctaaactttctcacttttctgaacttgactacgcagcgtcttttctaatctatttgttctccctttataagaagaatttaatcctttccgccctgctgggttgtaagaaaaaggactctcttcttttctataatctattgatatttgattatattacacatctaatgggttcccaataaatacatagtgaatagaattgaaccaaatttctttctagacatgtgaaaaaaaatcctgatctttaaatagaaagggtactttcaaagattatatatagaacctcttggtattttgtatttgcaatgaaaatattttaatttgggccaggtgcggtggctcacacctgtggtcccagcactctgggaggccgaggtgagcagatcatgaggtcaggcgttcgagaccagcctgaccaacatggtaaaaccccgtctcaatcaaaaatacaaaaattagccaggcatggtgacgcatgcctgtaatcccaactactcaggaggctgaggcaggagaatcacttgaacccgggaggtggaggttgcagtgagctgagatcatgccactgcactccagcctgggtagagagggagactccatctaaaaaagaaagaaagagagagagagaaagaaaagaaaagaaagaaaatattttaatttgtcttatgttcaacagttgcatcatatctgcatccttttgttaaaattgaacaggcttctagtttcatataataatttctggccaggcgcagtggctcacgcctgtaatcccagcactttgggaggccgaggcgggtggatcacctgaggtccggagttcgagaccagcctgaccaacatggagaaaccccatctctactaaaaatacaaaattagctgggcgtggtggcacatgcctgtaatctcagctactcgggaggctgaggcaggagaatggcttgaacccaggaggcggaggttgctgtgagccaagatcacgccattgcactccagccggggcaacaagagcgaaactccgtctcaaaataataataatcataatcatcatcatcataataataatttctaccaacagctggcaggaaaaaaatatgagagcatagtcatgaacttcagattccactccccttacttttggcattccattcctctgaattatagcttatatttctttattatctcagtttgatttagtctttctaaatattcacctctgtttccatccataaatatcgactgaactaccttttaatatactatctttttgtaacagagaaaatcaagtgtaggtggattattgtaagtgacactgaggaaatataaaaagaccttgacttgtccaggcgcggtggctcacgcctgtaatcccaccactttgggaggccgaggcgggtgaattacgagatcaggagatcaagaccatcctgaccaaatggtgaaatcctgtctctactgaaatacaaaacattagccgggcatggtggcaggcgcctgtagtcccagctacttgggaggctgaggctggagaatggcatgaacctgggaggcggagcttgcagtgagctgagatcatgccactgcactccagactggtgacagagtgagactccctctcaaaaaaaaaaaaaaaaaaaaaaaaaaaagaccttaacttgcttcaaacaagtcaggacccccaattccaattcttaggtctggcattcccatcagacacttaaactgtaggggcagtaaagttgcccatgtggctacagcttttgtggctgtgctgtacttgggaattttaatgttaccctctttgaattaggtccttcattgatcatgcatctcaaagtatctcagtgccacataaaaattttctttcagagtcatattttcccattatgaatgctacctactgcttatctgttgagtgtacacttttaaaccttctgtgggtggtggcccctttgccactgggtgagttagatgctgatcctggtcattatcgctgcctttccagccttttctgctcttacaccaagcacaagaattctctgctgatagtcaggatctagggctgggaaaatgggatgagttgtcctgttagacaggcccaaaaggagtattgtttaatccccagggtgtggggaagaaagatactcttgttttcttttccccaaatgtgtccatatacacccttctcctttgctggcagccaccaggcttgttgaggatctaccctcctctgcatatcatgtgcatcaagggaagccccaacccaagggaatacataatgatagtcctgagctatttcatggtgctctcgcagtcttgattgccctcttcggaattggacatggtcatattacgcaattttaggtaataaaatacaaagggcattcagctaagggaccttctgagaaaggtttttctcgtctagagaactaaacaggcatccttctccgggcactatgcgtagttctttattctacctggaacattctttctccagaaatctttgtgactaactctgtcatttccttcaagtcttattcaaatctcaacttaaaaaaaaaaaaaaccttcttaaaatttgaccacactaattagacagcaactgccccatctccctcttcccagccatctgaatccatttcccacttacctttttatgatagctcttctaggaaggcactccctcctccctgtgaatcatgtctccaggcaattgttccttgtgtagaggaacacaccaaatctgggctgctcctgtacaacaaactgaaggaggtagaattgattctgcaagaagttcaaagctaaataagaaggagtcttgtagcttctgtcttggtcttctggaatgctcactctggggaaagtgatctgccctgtactaagtctactctaaggccactgtgctgtctacatgaagaagccacaaatctaagctagccacatggggaagctgcatggaaagacaaatacgtggctagcccccagctgttggccgaagatccgcagccatcccaagtgaggagccagatgtacaagtgaaaaaactgtaacagccattccaatggagccttcagatcaattcagctttggctactatctgactgcaaacacatgaaagaacccaagcaagaaacacccacctgagcacagtcaactcacagaaccatgagcaatactgataaatggttatttttagccagtaagttctagggtgatatatagcaaaaggaacatctgtcctgttttttctggtttttcctatcatacactcattctgcaggattaacatgtgtaatatactttttttttttttttgagatggagtctcaatctgtcgcccaggctggagtgcagtggcatgatctcagctcactgcaacctccgcctgctgggttcaagtaattctcctgcctcagcctcccgagtagctgggactacaggcatccaccaccacgcccagctagtttttttttatttttagtagagacggggtttcaccatgctggccaggctggtctcgaactcctgacctcgtgatctgcccgccttggcctcccaagtgctgggattacaggcatgagccaccactcccggcctaatatacttttttaaattgtctttcactatgagaaggtgagctccatgaggccagggatattgtctgttttgttagctaatgtatccaaattacctaagaatagatcttagcgtggtaaatatttgttgaatgaacgagtgaatagatcagaatttcagtagctacgttgtgagtatgtggacagttcaccaagaatggcagaatggaaggatgggaggaacctggaataatgtcattgtgcttctggattacccagtcctggagcagctttgcctctgtgggccttgactagtcaagacattttgtgttgggtttttatgttaattccatttgcatcactataaaggaatacctgaggctgggtaatttataaggaaaagagatttcattggctcatggttctgcaggctgtacaggaagtgtggtgacagcctctgcttctggtgagggcttcagcaagcttacaatcatggtggaaggtgaaaggagaaccagcgtgtcacatggtgagagatggagtgagggggtgggaggtgccacactcttttaaacagtcagatcccacatgaactcactctgagtgagaactcacttattactgcaagaatggcactgagccattcgtgagggatccagccccatgatccagtctcccccaccgggccccacatccaacactggggattacatttcagcatgagatttgaagggaacaaacatccaacccatatcagttttctacaacctgcagcagaaagcatctcatctggcacatggtcttgcaaataattctgacttagatgcatgggactcagatatgactgaaccagaagataaatctaagtagcagacaccacagtattctcaaaaccactctttctctttctcttgttgaccgaggcttttctactgagcaaagcacctggtttataatatgttctttcattacgccttctcctaagagacctccttagtgtccctgcaatggatgtctggggagccaccaatctcttagagatgactagacatgtagccccagaaatggttacaccttgagcttttctctcagtgcagatgagatacattgcccatcccaccaatttgccacatttatctaaatttctgtgttaagctgggacctctaccactcaagctgggatgcccctcaccaccaccacactgcaaaaactaaacatttttcattagcctcctacttgcaattaagtacataaaacctgcaaaacaagtaataaaattaaggcactatttggttaatgccttttctcagaaatcacttttgcatgaagttcagttcagtattttatcagtgactacattagtctcgagaccctctacccaataggagggacaaagatgtacatgacacaggctcccttcaaagatgattaatacatgaactacatacagtattacaagggctccactagagatgtgagccccccagaaatgatattaatgtgcagaagagttagcaataaattttgcacaaggggtgacatttgagcttagactcgagcaatgagtagggttccaagaggtaaagaaaaaaatggaatggttttctaggaagaaaaccaggtctgggaagatctgatataacctgaggtagtttataagtctggaatgactgagttatcgggtatatggtggggaaggcagcagaggtgaaataagtaatatctaagcaaatgaaaaacatgtaattaggggagatgaaatataattaaattatttaccttaattcctcttttgactctttacatttgtcattcataaggaaacaatttcactaagattgttttgacctttttaccttatttggccaagtaaacaagggacagaaagtttttaatgtaaaatattcattcaacctgaaagaacattgatgattccagaccatttaaagttaaatattttagagttctcaattatttctatttggatgagtagaaccttttttcagacttcaggaatatatgtttagtttttaacagactaattgttcctgctttcatgccagcctcatgggcatcagcaggttcaaggttagtaggtaggaatctgccccctaagaatgcagcctaagagttaaggaatgcatgattacccctgtaattacttgagaggggctctgaaattctggcagggttggtgaggccaccagataacactgatcaagaatgtacacgaggttaggaattcagactgtagctgaagtggggagttcgggtaaacaggctctgaatggaaaagatcaggaattcaaatagacagttaagtcaagaaaccaacatcttagaaatgtaaacctcactttaagtcaaaggctctccaagctaagacttcataatatatttgccaaggcaagagctagtatctgcttacctgagtggtcctggagctgcggccagttgaaacaggagattgcagatggaatgtcagttagaatactttcagaggccagtaacagatacctgactttaaagttcttaagtttgtctttcccaaggttttctggtcataagaatcaccaggggcacttgattaaattattaattcacaagccccttcactggagattctgatgcaatagacttgggaatatatttttttttaacacgaactccagtggaatcaggcaagaagtgaaaaccctatcgttaataatagacacattagaaataatagagacatttgataatctagcacagttcccaaactttagtatgcatcagaatcccctgggggcttgttaaactacaggctggcaggctgctcccagcgtttctgatgcagtaggtccagcgtggagtccgagattctacatttctagtaggttgccaagttatgctgctactcctgtggtcaggaactgcactttgagaaccactaatcaaaataaactgaagtccaaagaccatcagacctagagctggttaattcaacagattagctatatcaagacttgaggtcagcttctctgggattctcttgtctttttcctcatggtcccaagatggcttcccactgcgccaagcaacatatccgcagacaacaataaccaaggcaagaaggaataaggttcaaggataactgtattgtgtgcgtgtgtgtgtgtgtgtactcatgcctgtgtgtctgtgtttggaaaagcaaacgtttcccagaagctccccaacaaatttcttcttatgtgtcaactagaactggatctcactgaacctctttaagccaatcactggctatgagaaacaagcttactgtgattggcttagaccagattttaattttttcctcagagctgtgtcctttgttgcccaatatctgaacataattgagcttctttaccaaggaacaagaagtaaatagctgttagttaggcaaatagctgggtatgtccacaaatgggttctgaaacaagtgtgattataatgaggttcagaattgaaaatattagtacaaatgctagtaaataatgtatgatattggctttcttatcaccatttgcaacagaataacagtctcatgaagaatttggcacagccattgtagaaaaagtgccttttcagagctcacagtatgcatgtactcatcttgcttttattatacctgtatatggaattgcaagctgtcccttcaggtaatgaaatttagacaagttggaacctgtataacagcaaatcaatactgaaattataggcaaagcctgtacttgtgcagactaacacataggatagaaagactttgtgatcaaaattcaacaaatcccacatttataggtatccaacatagagagaaaactatatatagtggtgtgtctttttatgtgtttgcgtttttctccttattcattcctgaaagtgtattttcttttaacagactcacaactcagctacaccccatatgcccacagtcaacacagtggaaaactgagttgtttatttgagcctcaagtcatccaaatacttcgttaaacgttgtagtaaaaggtctcccctgaattcaaggaggatgccctaagttttctgcatccttttgatagaggaaagtattaactaatgtcagactatctgttgttttattttcctttacagcactagattttgttaaggacattgataattttgaaagagaagctaagctaaggtgacaaatatatcttctgttggtcaatatctaaaattatgtattatttcttttttgactacaccttacagtggttagtttgcactttacgtaaaaaactgatgtctaccatcttccatctttgtaagcaccatccagcctaatagttgttggtttgaataatgccacaagctttgtccagaaaccaaaaacctgatttccaaagactagtctatgtagctgagcccttcattccataatcattaaactatggttaggacacagtatccagtctcccctcaaccttgtccaatcacagtctatgcagagatcatgtaactcgattaaaatctagaaccatagagacatttcccttccctggggcaaatgggaattgcacatgggggaaaatggtgtggataagcaaaaaacggaagtttccaaagtgcaacagaatattgataattttagtacatttcaacatacagtgagtgtaatgacggcattttcctactgcttccttagttgtgaagattttgttttttcttctgggttcactgccgggaaaagagcagaaaatgttttagagcctctgccagcagagggggcatttaccatttgtgcataaggtctctggcactgtgccctggggttctcttttctatatgtttctaacagtcacacacagcagtgtgactgtttacagatactttaccgtcttctctgattgaagcagggactggtttgccagcaacttttggttgtttttgtttttttgaagaccatgcaactaacagatgtttgttgttggctccatatctacattctttgaaagctggagaatcaaattgctgacattcagacaacactaattcccatatccagggagcctaatttgccgtccctgagatcctgattcctggtgttcacgggtttaaaaaccatttcagtgacacaatataagaatgggcttgggagatgcagcgctgtctccactaaagataatcacattttataaacatctgcgtcattactggtatgattcatctctaagctgtatacagctgtgtttccagtttcaattaacaatcccttaattgcatatccatctcatgttactaatttagttaatttattcataattaagagtattctgttttctaccaaggtttgtcgagctcagaacattataaagaaaaatattttaaggcagcatctccgagggattttgtttcttataatcacatcacagtaaaatgtcattcatgcgcccaaaggaagatgaattgctaagggatttttttttccagtaaaataagaagctttgggaagctgcagtgtgttgtgtttttaaaccaagttaaatgcgatgcattttgttcttttctttctccttccctgacatcctctcaaaaaaattatcattttatttgtattattgcttaagtatcacagcaaatccagtcaccagtgcaaataaaactgtcattaccctgtcaggtaatggtgtctcttaaaatctaagctataaagtctgtacattttagaggacattaagatcaagaatttttaaattgcctaagtctaagcaagtggagtacacccttgtggaaaatggaaggcagatgaaaacatgatgccaggcagtgaattcattttagtttgatcttttctacaaaaatacatatatccgtgcagcaagagtcttgcctgtgttagtacatgtgtctgtgtgtcattcaaagcagcaataacaaaaaattaagaccatttctcactttgtttattgttcaagaactcccacctatagccttgacctgtgtttgagcttaaaaaaaaaaaaagtcttataactgcccagtggtttggagattttacacaatagaaataataagccatcttttgcctcacatgaattctactaaaatcaaaactccataggatactttccaaagtaactggtgaaaggaaaagtgtggtagtataggtatgcatattatccccatcactttatttctgagctcttctattttttaaaaattttaatttgtatcttaaaagggcaaaacataagaagaggtaggagtattctaaatttcagtgacaacaaattcatttattttacaatttaaccattgcccgtcaacatttacttaaaatttcagcatgggaggttttaaacacttctagagtcccatcttaccccatttccacgatgcttttcttctccatgtgttgctgcagtttaatattgtctgcgtgttttaatatgttaaacgagttaaacatagagtaggaagttaaaactgttagcagctatatgtttcccaagattgatgaaaattcaggtaacactccaacctgttaaagatacctgcaatctggccaggtgcggtggcccatgcctataatcccagcactttgagaggccaaggcaggcagatcacctgaggccaggagttcgagaccagcttggccaacatggtgaaaccccgtctctactaaaaatacaaaaaacatttagccgggtgtggtggcatgcacccatagtcccagctactcgggaggctgaggtgggagaattgcttgaacccggagcctgggtgacagagtaagactctgtctcaaaaagaaaaagaaaaaaaaaaatatatatatatatatgtgtgtgtgtttatatatatatatatgtgtgtgtatatatacatatatatatgtgtatatatatatgtgtatatatatatatatatgtgtgtgtgtatatatatatatatatatgtgtgtgtgtgtgtatatatatatatagaaagagagagagagagagagagagagagtaagcagggaggggttgaagccagaaaagactagaaattatctaggccaaaccctttaatttatagattaggaaatagtttctggttgacttagctgagacgttctcatttgttaaaagcaagatcagaaatcagacacaattcaacgctcttcactacaccttgtttttctctttgtggaaaacaagacgtatcctgttcaaaaatttatgctgtttatctgaaagcccaaaatgcctgtttacatcatattttccattttgcaatagcagctcattttggggattattttctgatgaaatctctaggtttagttgtacttgaatatctttttatctgtacacactggaatatgcatataataattgatagaaatgtggattttaaaagtagagatgatcattattattttatgatcctttaagttaataaaattcacctagaataaaataaacaagtttaactaaagttctcgcattttcccagaaatcgtagactagaaactagtcttatttgcttattttattccaaagcttattttacctctattattttgtggttctataaaatatttctgtgtattcctccaaagaacctcttggaaaagaaagtaaacatcacatctgaaaaatagctgggcattttttcattatctctgcaaggggaggggacgtgaaaggcaaccccatatagaaactcaactccctgctttttacaatgaatgaagtttttccactgcactgtcagaatggtaattcttgctaactactcacctatttcacaacattaacagagttccaggattcatgctttaatattgcataatggtccatgttttgaacatgaggagtggcagcggagattacactttgattccttggatttcatgtggcactggatgggagcaaggcactgattttaagttgagataaaaaggagaagtcagtcaatgcctgcagccagacaggactcttgtaatagctagggagtatgcctcatttggatatgcatgactgccgggcaaggacactgccatgaatcgctaatggcagcagttgtatgacataagagagatgtgtatcagcaactcacaagttgactttgttacatgttatgaacacattcctgtgggcactcattcatagaagtgagaaatgtggacaccacagtgtcccaggcctttgttaccttatggcctgggaatatcttgctttgctggaacatgaagccacgtctggttataagaagaagtttgatctgggagcaaaattgcctgttcacgcatgtctttctcacttctttaaaactaacttgctataagggtgattaaaaaaaacagatgtcaggtgagagttttgctttgcatcaacttcctacttgtagaggtaataacataaaccttgcctggcaatcattatttgtcatccagctgagggtgtttactcttgagaaagaagtaatggacaaaattgacttggattctggttctatgtttcccattaattgactctggacatatacatgcaatttaatccatcttactaaaaacatgaccaactcacaggatgtaaattctattctatagaaagggctttccctcagtagttagtcaagggacggttcctaactcctgtctttattgagcttattttccaaaataaatgtattattttctactttgttcacagagcaaggcagcataaagaaattaagcaacaaaacaatagtgtatttttacccaactttctagaaaacacccatttttcttaagttttgatatttttttgccaacaggcagtcaaaaagaagataaataaaactgggttaagttggtaatgacacaataaataaatgagatgaagaaagaggcaataaatatgagtggataccaacaagaaacatgttcaagccctgaaaaaataatgagaaaaggtagaactattaataatacatcccgctctcgtatcacaccttgctccccagatacatcctatctgtcctggcaccatgttgatgctgttgttctgtaagctatgccaatgaacatgttggatgacctactccagctctacctcaagatttccaaataagaaaaggacccagggatctccttgctgaggtctttatccatttactcaggtcacaagtactaattaagcagctcttatgtgcaaaatgttattgcttcaggtcagtttttcctatactgctgttctataagagaggaagaaggtccctgccctcagaaagccctagaatacagatctagagatgggttcaacatctttgttatgcaattatttcattccaattgtaatgagtacttagaaaggacaaaagcagagtgctgagagagtataacagagggacttgacctggtgtagtaggcctggaaagtttcctggggaagtggtattttagacaaacaacacacacatacacccatgaatgtatacgtgtggagaatgtattctaagtaactatgatgaatgtatttcttactgtaggtcatggtcaaagtttgaaaactattgttctaactagtattataattccagggatagtagaggtcatgtgacctgtttagcacatgcctgccttaacagtatctagtaggccaggcaatgtggctcacacctgtaatcccagcactttgggaggccaaggcaggtggatcacttgaggccaggagtctgagaccagcctggccaccacggtgaaaccgtgtctctgctaaaaatacaaaaattagccaggtgtggtggtggtgcctgtagtcccatctactggggaggctgaggcaggagaattgcttgaacccgggaggcggaagttgccgtgagctgagatcatgccactgcactccggcctgggccacagagtgagactctctggaaaaaaacaaaaaacaaaaaaaaagaatgtctagtaaataagtcagtgccaagcaactacctgataactgttaccaccttagtcatcaccgaaggcagaaggtcttgcattcattggaggagagttaccaatctaagacatttgcatgaaaatgtgcacagagccctcacctgataatcaaagcatgttccaacacttctctttggataaaataagagttacatctcaatgaaatcacttgtggatcaagttctcatcctttcgtaaataaagagaggggcagcaagaaatggaagtgagcacatataagtgtgggaacctgtactttcctaacctataaagcattggatgtagtttttgctattggtgcgcatggagtcatgtggccttggagcagttaggtaccttccctgatgataggggagaaggcaaagaaattgatgatacatctctctcattgtcattccctagtatattacacttaaatctaactgccctattttgtgattgccttactgctgtggcttgaatatttgtgtctccccaaaattcatatgtggaaacctaattccatatatgatggtattaggaggtaggccccttgggaggtgattagatcatgagggcagagcccacatgaatgagattagaacccttataaaagagacccagagagctgctttgccctttttgccatgagaacacaagaaggtgctatctatgaacaagaaagcaggccttcaccaaacactgaatctgccagcgccttgatatcagacttcctagccttcagaattgtgagaaaaaaactttggttgtctataagccacccagtttatgatattttgttatagcattccaacggactaaaacattcattttccagaaaatctactccatttataagccagcattcttttttttttttttttaattttctacagatctctgcagaaacatgcagagtaataatagggccaggcacggtggctcacgcctgtaatcccagcactttgggaggccacagtgggtggatcacctgaggtcaggagttcgagaccagcctggccaacatggtggaaccccgtctctactaaaaatacaaaaaattagccgggcatggtggtgggtacctataatcctagctactcaggaggctgaggcaggagaatcacttgaactcaggaggcagaggttgcagtgagccaagatcccaccattgcactctagcctggacaagaatagtgaaactgtctccaaaaaaaaaaaaaagaagtgataatatatttgctgtatatattagttatagatagttatattgcagtactatcagaagctatgccacatattatttacgtatttcttaagatatagaaaacatccctcccctgcagtcattagtacttttgcattcaaacttcaaatgaaacaggactttagaaattataggcttggtgccatcctggccaacatggtgaaactcgtctctactaaaaatacaaaaattagctgggcgtggtggtgcacacccgtagtcccagctactcgggaggctgaggcaggagaatcacttgaacctgggaggaggaggttgcagtgagccgagatcgcgccactgcactccagcctggcgacagagcgagactccgtctcaaaaaaaaaagaaaaaaaagaaaaaaagaaaagaaaaaagaaattataggcttggtgatttctcaggcattaactcaagaaagcagcctttataccgattacctacattcacccagcacttaccccattaatttctaatgttgcttggaacaaatgaacattcctggaatgcaagctaaatgaaagagccccgaagaagaacagggcatttcctggttcctcatattgacaaatttaaaagcctgtgctataatatgggctcctgtttcctttcaagtttgtctttgaataagtggacagagtagctgaaagcagagtatttaaagctttgaaacgaccactttatttcagtctctgttcttgctgggaccactcttataaatgaggagattagaaaatcacctagaactatttaatcgttgtgcagaagaccctcttaccccaaatatttacttaccgctcattttattggcacactgcctcaaattccacctgctgtgaactgacctaagtgaatttaggtcacgtgcaactattaggttctttttgggaaataatggagaaccacagatgtgtttgaggtggatgaggaatggctacctcaagccgcagcttcatgcttcatgctgaagtcctccacaagtgcaatcatgtcgttaaccaacatttgttagaaggcaggcagaagtcagcttacagcctgttctacaatttttatgaagtgtaggattttaggcttaaattgacaccattgcaaatacagtattctcttacctttagatttggcatcaggtcacaagaattcttcctaagccaatggttggatacaaggccattggagaccagacgtaaaattaaaagcccaagcaacaggttttgctggattcttatatcctgtttatgcaatgttaggggatgtcattaaaatattttagttaatccatgtatcttgattgtcttaaattttactaatgagatcctatagggatattcattgcaatccactatttccctcagcaaaaacacatttgcgatatctattacatgcattacaaaatcctccaaggttcacagagatatatagtagtagcagtctctgggttttggcctttttcataagatgaaggctgtgctgtcctagaatatgaattcctaattaaaataaccatttgcctcaagcctctagagttgaaggttgcactaactgcacatataaaatatccaactatctatgttgagatatttaaaattaattacagatattgtaacaccattatttaacttaaattccattacaggtcctttgagtatgcaaaatatttctttgagatgtggtaacccctttaactgatcaggaaataaacctttattatcaagttgttatcccaccttgacaggcctaaagcgcagaccacatatcagaatcccctgggcagcttataaagctcctcatgcccaggctgcatctcagaccaattcaatctctgggggtgggctccaagcatcagcatttgttgaaaatccccaggattacaaagtgcggtgaagtttgcaaacccttgtaataagagaatgggaggagggatggctgtttgccaagcagaaccaggaatgaggaaggatattggtaaacaaaatttatccataattgacttttcatgaatcacagtcctactgagacccagccttgtctcatgagactttggctacgatgatgagtgagaaaaggactcctcctaatttaccagactcttgattagaagcaaatgaaattttggaaaagagacaagtcactttcaaaagaccccagcctgtacctgaccctacctctggactccatagtaatggcaggtagtggtcattcctggagtaactctgtatttcttaaaggaacatttgcataatgaacctacagcaatctggaagacgactggggtaaatagagaatttgttgattttagatggctgaatactatccgtgcagagcaattaaaaggacaactgtcagaatcaagtaagagaaaggaaataagagaagtctcatgttagtagaccttgtttgatcaatgtgttttcatcttgtatatgattaataaaataagtttgggagttaggatcaacctttgtttactcactggagaataacttgcatatagaatgaagctgggattgtccaggctggtttttttccatttggaagtttggatacaatacaaggaagcctgaattccaaactgtttctcttaaagagtgcctttctgagccgctattaaggaatgcttattgtttcgaaaatggtagcacagaagtgttataactagagtacaccttgtgcctgcaattaattacccagtgtcttcaaaaattcttgtcttttgctggtagaaaacctttgaaactatagttgtctgtggtattcactgcagcaccttagatataaagagagaaatttattttcagaggaatcttgagacagtttgtgtgtgtgtgtgcatgcctgcttacacatctattggttttccccaaggattgtagaaatcccattaaaattccagcttcttaaggagctactgaaactccagtttttcatattttcttttataatatttggatgcgtttaggtaaacttgcagcattttaattatgtctgtatcagatgagcggaagaaatgtaaaagggtttggggagagatttaattttagatagcggcgtaattaatagcatttggaaaaactagtggaactttaattaaatgtctctacattaatttagtcatttaattgaacatgtagtgggatagtccttacaatttttcacccttactctttgaggaaaaatgatttttgaataacaaagcatcagtatgactactttttattatttagctgtatgttcactacttggcactttgtttaatttttccccccatatgtttcgagctttttaaaacattaatttggcttgtcgcttttatcttaaaaactataaatctgggggccgggtgcagtggctcatgcctgtaatcccagcactttgggaggccgaggtgggtagatcatttgatgtcaggagttcaagaccagcctgaccaacatgacgaaaccctgtctctactgaatacaaaaaaaactagccgggtgtggtggtgcatgcctgtaatcccagctacttgggaggctgaggcaggagaattgctggaacccagggggctaaggttgcagtgagcagatattgcaccactgcactccagcctgggcaacagagtgaaactccatctcaaaaaataataataaaataaagaaataaagaaaactataaatctgggagaaaccgtatttggaaacattgagcaactgtttcttttcctttattttagactttaatattcactagagtcatgttgtaaagttttcaccttaatattgtaggctttttttttttttttactttgccaacttaactggcttttttaaagtggtgttatgctgcagcagtgtatctgaatttcagcagtgccttttacgtggctgctcacaatcttattaaactacatgaattatacatggagagaaatataatttggtaaatttggtgatgtttcaataaccatgcccaaggaggaatgttgtgttaaactgtcaatttgagaagtgttttgtggtgctaaccacagagtgaattcagttctacttcatttcacaaccctccataaatagtgccccctaaaagtggtgcctccttgcctgtactttgacccagatttttgtcatttttctagataagcatatacattgtgcacttattaatttttcaaatgacacaaaggtgagaatgggagtcaacacactgaaagatcaaaatcaagactcaaaataagattataacagactgggatactgtaccaaaataaaaaaattaaaataaaatttaacaagaacaagcaagatgtcctgcctttaagatttttaaagtcttttgtacaaatataggctgaggaacatctgactttgtggcgctttatatgaaaaacaaattgggattttaaataaccacaaggactgtattaatctccagtatgatctggtgtggcttactgtacgaggcaatacagtattagattgcattaatgaaattcacaaatgttccattaatctcttcactagttaaaccacatctgcagtcatattgacttatgagcatcacgtatgatgagaacactgaaaaatcataatacattgacagcagggcaaccaagattgtgaaaggtatagcgatggttatatgacaaatatttgaaagaatctagaatgttcagtaagaagataacatgaaaatacaggacagcttcttcatgcatctggggagggtgggtaaaggacacagcacacttaattaagtaagattgtagaagagaactatgggcaagtgttacagtggagcttactctgagtaaggaaaatgtaaacgttagagttgttattaagtggcatgggctgcttcacaaatttccatcattttttaatctgattcatctgctaataggacaaactgtaacaatagcttaaacaatagagaaatgtaggtctctctcatgtacaagcccagaactaggtagatcaggcctccttccgctattctgcttcactaagtccgaagtcctcctttaccttgtcctgccatggtggcctcaattctcgttgtcaccacatggtccaatatgtctgcttcagctccagccaacacatctgagttccagcccccagcaacatggaagaaggaaggaggcacagagagggcgtgtgccagcagtgttgtgagaaaatctttcagaaactgtcatgaaatgtatcccctgatagttccttcaccagaactttgtcccatgattatatttacatctatgtgaggctaagaaatatattctttccttcaggcatctacatacccaactgaaaattatgagttctattgccacaagaaaaaatggaaaatatatggggacaatcaacagtacttgcacaaagatgttttacagagaattactcttttacctgggaattttacaagataaactttaagatcctatcaactctctctctctctttttttttttttttttttttgagacaagagtctcgctctgtcacccaggctggaatgtagtggtgcgatctcggctcactgtaacctccacctcccgggttcaagtgattcttctgcctcagcctcccgagtagctgggactgcaggcgcccgccaccatgcctggctaatttttgtatttttagtagagacggggtttcaccgtgttggccaggctggtctcgaactcctgacctcaggtgactcgcccgcctcgacctccctaagtgctgggattgggattacaggcatgagccaccacgcccagccagatcatctctggaggcagggggatcacttgaggtcaggagtttgaggccagtccggccaacatgacgaaaccctgtctctactaaaagtacaaaaattagctgggtgtggtggcaggcaactgtagtcccagctactcgggaggctgaggcaggagaatagcttgaacccaggaggccaaggttacagtgagccgagatcgtgccactgcactccagcctgggtgacagtgagactctaactcaaaaaacaaacaaaaagagtctatgatcctataatttatagacaacatacaacctcctttctctacaaagagaattggttctcaagggctgtttggaaattcatttccttttaagtccaaaatgacatacaaaagtgaccaatatatacaatgtacacccttctacaataagttctcttttgttgccgtagtaatcgcatgtcttttcttaaaggaacacttttttgactcttttgtacttttgaacatagcggtgttaataataatatttataaaacattatgaaaatatgcacacaaaacacaacacaggctaagaaaacctaatggtggcctaaagtaagttctgatgtcctctgttggtggtattcttcattgccatgcttctgctgtgcctgggacctttattgctacctatgggaagttgtaagtagagaagtttctttactacagggatgtgaacaatcattgtaagtaaggaataatgaattcacataagttcacagagcatgtttttctgccctggtaatactgcatttctcactttgcatttaaagtacctacgcccttacacagaaaaagttatcggggttgggtgcagtggctcacgcctgtaatcccaacactttgggaggccgaagcagggggatcacttgaggtcaggagttcgagaccagcctgggcaacatggtgacaccctgtctctactgaaaaaaaaaaaaaaaaaaaaaaacacacacacagaaaaattagccaggtatggcggtacatgcctgtagtcccagctacttgggaggctgatgtggaagaatcgcttgaacctgagaggtggaggttgcagtgagccgagatcgcaccacttcactccagcctgagtgacagagtgagattccatctcataaatatataaatatatatatataattatcgattgattaatattattatatggtccccattactctaaactctcaaaatgtaatgtaggtcaaaatcagaaaaaggccatactgtctactccttcctctgtttcattccaactataagagaaagggagagggcaaaacaaagatgacaggaggccaaattgtacatagaattcatggaaattcttacccaacatgtaaaattatgatagtataaggaaaagtatactgcaaaaattaaacttctacattgtgaaatggagaacatttttacatctagctctattgcttctccctgtggagctgttctaagcacaaagttcccattacataatgaacaactccttaaatactgtgcaactatttctcactagaagcacgatgcagcaaactctgtttctcagtaaccatttatatcatacctagtggtaccgagttctataataaaagggtgatatgtgcatattttgtggtcatagagtgcaaagttgacatctacagtttaaagcattgcattgcatgaataaggtcaaaatttaaatacttttctatgatcatgttctttacattaaaggttaaagatgcatgccgctttaaaaatggtttaagggccggacacggtgactcacgtctataatcctggcactttgggaggctgaggtgggcagatcacccgaggtcagacgttcaagaccagcctggccaacatggcaaaaccctgtctctactaaaaaatacaaaaattagtcaggcatggtggcgggcgcctgtaatcccagctactcgggaggctgaggcaggacaatctctggaacccggaaggcagaggttgcagtgagcagagatcgtgtcactgccctccagcctgggcgatagagcaagactctatctatctcaaaaaaataaatgaataaaataaaataaaaatggtttaagaacttcaaaccatctggcaccagaaaacacctaaattgaattaaaaatctggaaatttaatttcacaacttgtcctttttcaagcctaccctaagttttgtttacttaatggggagaatctgttttatttgttcctatgtagaagactgctgattttatcatgattgtattagggcccaaggatatttaaaatatttcagtagctattacttatactttatatctgcattgcactttagagttgactgagcattttcaaagtattatcttaccaaattgccacaatagtcttgagaggctagtaaatcatgggagaagcccccatttccccactggaaagcagagaaaacccccattgtagtaaaggaggggttccctccagagctcttgtggttgtgttgaggaggaagtattaatgctgctgggcatgacttacaagaaataagtcaattcacttaagcaaaagtgctatgatcctgtataccatgtgagcagctctaggatggggtcacccagcattttggagcagacattagaacatctggagggagtaaacgcaaagaaaatgggctagatacctttccttggatgggaaaggataacattaagataccaagatcaaatgttcaaagagcacatatacaccagagaatactatgcagccataaaaaatgatgaattcatgtcctttgtagggacatggatgaagctggaaaccatcattctcagcaaactatcacaaggaccaaaaaccaaacaccccatgttctcactcataggtgggaattgaacaatgagaacacatggacaaaggaaggggaacatcacacaccggggaatgttttggggttgggggagtggggagggatagcattaggagatatacgtaacgctaaatgatgagttaatgggtgcagcacaccagcatggcacatgtatacatatgtaacaaacctgcacgttgtgcacatgtaccctaaaactttaagtataataataataaaattttttgtaaaagcattgtataataaaagtagtaagataaaccagtaaaaacaaaacaaaacaaaacaaaacaaaaaaaagttcaaagaggccgggtgcagtggctcacgcctgtaatcccagcactttgggaggccgaggcaggcggatcacttgaagtcaggacttcgagaccagcctggccaacacggtgaaacctcgtttccactaaaaatacaaaaattagctggatatgatggtgcgtacctgtaatcccagctacactgaggcatgagaatcacttaaacctgggaggcagaggttgcagtgagctgagattgcaccactgcactctaatgtgggcaacaaagcaagactctgtctcaaattaaaaaaaaaaaaagtttaaagaaaaataagttatttctccatgcttcaggagatatgtttcgcaggagaaagaggcttaatagagaaaacagatccctacaaacatttgtggtttttaaaactgccccattggttactaagtggataacatgagcgtgatgccagattcagtactctagtgagccatgcagctttgctgtgctctgcacctgatgagtgtggcctcacttcttataaatgcctgtcattgctaacaggggtccttgctgaaacaacagggctggactaatgctctagttcccttcctggaaaacctatcccaaagctgagatcctcatgatgccttctctcatatatgaatgattgcaggttacgctatcatcattaaatcgaaacattttagaccactttgcgtttgtttgtttgtttgtctcattatgtccagttttatcctgtttcataatttaataaatttttattgggtctgtcttctggttaaatgttgtgtgtataaaaaataaagtcaagagagagaacaggagttatggaactaatgacaaatccatccttcagctaaataaaattatactatggatgatttgagctgtacgttgagtgataatttttaaaaataagatagatcgggtgcggtggctcatgcctaaaatcccagcactttgagaggccgaggcggatggatcacgaggtcaggagttcgagaccatcctggctaacatggtgaaaccccatctctacttaaaaaaaaaaaaatacaaaaaattagccaggcgtggtggtgggtgcctgtagtcccagctactcgggaggctgaggcaggagaatggcgtgaacccgggaggtgaagctcgcagtgagccaagattgcaccactgcactccagcctgggcaacagagccagactctgtctcaaaaaaaaaaagaaaaaaaaaaagggccaagcatgctggctcacacctgtaatcccagcactttgagaggccgaggtgggtggatcacctgaggtcaggaattcgagaccagcctggccaacatagtgaaaccctgtctctactaaaaatacaaaaaattagctggacgtggtgacaggcacctgtaatcacagctactacggaggctgaggcaggagaattgcttgaacccaggaggcagaggttgcagtgagccgagattgtgccattgcactccagcctgggcaacaagaacgaaactctgtctcaaataaaatgaaataaaataataataaaaaataagataaagtatcacaagtaagatgtagttgaaacttcatgcatttttctatgatgcctatgatattcaaaagataactgaatttcatgagcagagttcaagaacttctgagtatacttttcattgatgacttaatgtaatggatttctatgatgatggcactatattcttttggtgtttatggtattaataaaaaattgtggtaaagcttgtggaaatgaacatgccttggattagggtgccttaaatgtgcctttgtaaatgcagctaggagactccaagtcacccttctagtctaactgctactcctttcttttacaaactacatgccaactaaactgaccttgatctgtttatgaaaaggcggtataggaacaggggctctgcaattggacagatccaattctaatcaatccactccattgatagatatataaccttgagtccttcctgtgcctcagtttcctcatctgtaaaatggaattaaaaaccaacttcgtgaggcttttggagaatgaaaatgacataactcaaagattattgggtatcagaaacaataatgttatctatcactgtctttactgttattattattattgtcattattattattttctctacctggaacaccaattccacaaactcttaatgtcaagaccatgctgtatcatggagccttccctgattcctccatatgaaaataattaattctcatattaataatattacttttctagttgtattttctttttttagcttttattttaggtttgacggtacatgtgaaggtttgttacataggtaaacacatgtcatggaggtttgttgtacacattattttatcacccagatattaagcccagtactcaatagttatcttttctgcctactcgtattttcattatccccaagtatactatacatatcttaaaattaggatccatgttgaaaaaacattgatatttcctatggcttctaacacagtacattgcacttagatattcagcaactctgtattgaatgtatgggtacaatctgctcttagtttctaatttggtattaatatgttcaagcctcaagagctcatgtaaatgatggtttgactatattgcccatcttttgttaagttgaaaagctgaaattcatgcactgtttgttagtgtagtaatttgtgacaacgtctagctattaagtcttttctaggtataaaacctttatatctgtcattgttcccctcttgtgtttttgctttaatatcgttgaaagcatctattattggaactttcacttctgaatagtacttttgagaacctgtatagaatttcagaggccttagaaaattgtcatagattgcttttagtatatggtttaccactgtggtctcttaacttttcaaaaagtatttccaaagggcacttacatccataagtggaaattgatttacatctattattgctgattgttcactattctgaacttcggctaaacaggtgatttaggcagaatttttttaaatattagattttttcctactttctaaatattttgtagctctttcttattaatttgagtcaacttatgctcgcttttttttgtcaattatagatggttgtcaggggtttggcaaatgtcatatgaaggtaattctttaaaagttgggatttttgaactgtttatttctactacttttgattttgctggaaattatcattctattaaagggacaaaagggtgctcagaaatatgcattgaaaaatttcttacagatttatcaaccattgccctcaggcactgatattcagccagtatgttccaatacatccatgtctttccattttaaaccttttaattctgttctaatttttcattgcctgtgcctgattgttctgtatccatctgatacgaatggttaagtacaacattttaaatatcactcttgcctatacatattatttttcttgtcagatgatataattgtagtcattacatgtttcttaagcacaactgaaatcttaatttaaatcaataagtcttgtttctgtggccattgtttcccagaactctccggatttctaagcatggtggttattcttccaggaatagtgccgagagtcttcagcagcatgcatttctctctaattgacattatttcacactctccattttccttactattgaaaactgtatttcattggtattttgccaaggatcctgctctgtttcataataatgttctgttcgcactctctgcactgacaaatacctattccatgcatcaattgcataaatggcaatttgaaagcatttaaccacagctggatatttttcattgattcttttcatctgaagatcattcattaggcttctccctcctgtttcttctcacatccatacctcctttcctcctatgtacatagtgtcttttgcattttctgtatttaagtgtaaattgctgactacagttatgcttttacctcattccatggtcataatgaaatcacaaatttaaaaatgtactactttttaaacctgttttctgacttgtccatctaaatgcaattttataattcttcgacattcagcctcctggtgaatgatttctgcaatctctccaagacatctgtgcagtgttatggattatattgattgcattttgtccatgttcaaatttgcagaatgtaacctacagaatatatattgactaataaagaaatgcatccacatggtggatggttgtaaagagaaaatatatattggtgtgcagcaggcgcccacacaaatgaaatctagaaaacagcagcttgccatgtcagagttgcaaatgaaggctgtggctacaaaacacagaaagtctggagtgtatgaaaggtttttcttccaaattcattcacacataaaaatgaaaaaattgaaaaatcatatatgtgcaccttaatttttatatcgcattggtgtttgggcatacgaccctgagattttcataccctcgatttttttaatataaccacctgagcgtttcttcccatggggttactttagaagatggggggtgtacacactacgtatgtatgtcaataaagaaatgaaggaataaaggaggaaagaagtgaagaaggctgggggtaggaagggagggagaaattcagtgattcattacttattcatcatcctaaactggcatataaaataatatgtttaaatcagtctaaaattttcattgtataatctctgaaataactagtccccactccctaaactgtttggtgtaaatatttatctatgtctaatcatttctatgcaaaatagccttatatatattttcattttcataagatcatctaagaatcaaaggaaaagctattttaggcaatgaacataggcagtgatttcaaaatagaatttgagaaatgcaaggatagatggaatcacaaaagatgatctcattcatggtgttttaaaccctacaaatagatttctgtttagttgacctcatttcaatagcttctcatttttttcagaagtgtatttgatgtgtatatttctaataaacttatttttctttttgtacccagtattaaggagcacagcatttatatccactgaacaaaggataactgaaaggaaactccttgatatccaacttggagtatttgtttctcgaatgaatatgagtttatataagtagtttttttcacatacataaaattagaatttgtttgtattattgatattatttcagaacagcggatttaacgtcatagatgatctagatgtgtcctttccttagaaatctttaaaatgaatcacatagtctagaaacagatccagatactacatgctctcatcagaaaggactttcttctcttcgtgtcaagttcagtgttggcaccgtatagacaaagcgtgttaaaatagcagggttcttgttctctgacacattacaagagaggcaagattataaaactgctatgtgtctcattataattcccattagtttcatttgcttcaaaacattcacttctgtgctttttgcaaaagctttcaaacttattttttgatgattctaaaagtaattcttctatgtcttttcctagtgatactagcattagttttcttttccaattgtactaggaggcatgagagattatcgatgccctattttcttgtctaaataggcaacccaaataatcatagtgacctgttcatttatattatctttatttcttgcctcatacttcttcatatttcttcatttcccatgtttccttattctttggagccagaaacgatcacgttaatcactctttccattagttttctcctatacattttctgatctttctctgagccagttaagagtcattcagccatttgataatggacactagtttactttgaccttgcaaacacaaataccctgtttgatctttatttgctgagagcagtaagacagaagaattacaataaactttttagcacccttctgttcaattctttttcagaaatcgttccctcaaaaagcctattctaggctctttcttttggcagtttcctagaattttcctttgcttttcaccaactggaacattatcactagaagtaaactaagggaccatctaattcaacaccctcgttttgtactttaggatactgaagccaagagaagctaatttttttgcctgccataacacaactagttagtgaagcagccaaaactataagggatcttgccaccataagctttatcggcccatccgtttatctcctcaaagcagccctatacctgatttccttatttctgttctctaagtaagccaagctcagaccttagagtgaccttcccctaatccaccctgcctgacatccaataaactgacaaatccagttgattatgaagctacagtgtttttcaaaccataccataattgtctaggctgttgccatgctctacacaccagttttcttattccagtccctccctgccccagtcccagttcactctactcagcctctctactgcaatggataaaatcacagtttccagattcacaaagctcacagctctgccactttctagccttgtatttgtgtttcagttgctgctgaaactctctaagcctattttccatctataaaatggaaaccaacccagaggctcgttgtattacagagatattgcatgaaaagcatttagcgcagtgtctggcccataagaagtcctcagtaaatagtagtcttggggaagcagtagggtgttgtagtaagagagcagagcaggggacagcaaactacaggtctcagtacaaattcaacatggggcctgggttttttttaatagcaggggagctaaaaacagtttacttgttttaataagttgtacgaaacccaaagaagaatatgtaacggagatttatgtgttcctcaaagccagaaatatttactttctggccctttacagagaactttcattaattcctgttgacagctgtcagggtatgaatcctctctaccacttagaaactgtgtaaccttgggcaaatgttttaacctctccaaggtttggtttccctgactgtgaatagtacctatgttacagggttgttatgagaattaaatgagatcatttatatcaggtgcttagctcactagctgaaataggatttaataaatgttagctgacatggttacgtctactcattgttgcagataaatagcctctaagtgcagctttaatagtgattgtttcttaaaatttttgaacaaagtttttctatttcttatccaattaaataaatattccacattctggcattcaatatttctaacgacatcaagcaactctaaaatcattgaatgttttaaagcaacaggaaaccttagaaataactcatctaaactcatatcatagatatggaaactaagggccaataaaaccaaggcttctaggacctgaaatcagatcctctctttttaggtagtgtgatcttcatcgtgcttctgccatgcaatctcagaatttaaagggatttaagaatcattcattttcttcctaaggcaggattcgaccctataaaatccctgtcagtttggtcattcaaacccagtttgagtacagtcattgatgataaatcacccttttcccagggagcagttctggttgtttcaaagtctttataataaatgaaaattggctttcctgaaatctctatatattgatctattcctgcccactggagccaaagagaaacgtcacttctctacatctgtaaaatactcgttgtcaattttcgtatcttctctaagcatcctcgtttcaagctgatgtgaactagttgggtttttgattgttttcattgtcctgctaagtcgaaaagctaagaaaagcttggctctttcatcactgttatatatcccactgtgtaacagaacttgagttcagggtatacactctaaataactgcttttgtaaaagtattcaattatattgatttttttcgttccctctgttgttcctcataattaccctcagtcaagactttcatcttcgtctttatcttcctctgcaagaattaacagtggtcccttttgtgaacttcaaatatctgagactggtctcagttaatttaggaagtttattttgccaaggttgagaatatgcacccatgaaacagcctcaggaggttctaacgacatgtgcccaaggtgtttggggcacagcttggttttatatatatttagggagacatgagacatcaaccaatatatgtaagatgtacatttgttccatccagaagggtgggacaacttgaagcaaggaggggcttccaggtcacaggtaggtgagagataaatggttgcattcttttgagtatctgattcgcctttccaaaggaggcaatcagataagcatctatctcagtgagcagagggatgactttgaatagaatgggagacaggtttgccctaagcagttcccagcttgacttttccctttagtttggtgattttgaggccccaagatttattttcctttcacactttcaatataagctatccagaactgatgataatattccagatatggcccaaccaatggaaatgattgtgtttcctacataccatatcacaatcaaacctgttttgcaccttgcatttactttctttattaatgatgtcattgcaatttagaaaatttggggccacatttacttcttcctctctattatcttcagtttttatttggtcactaaattctgtttgctgactcttatatctaaaaataaaaacactcaaatccagctattcctctctaactactctgcccttccctcagtcctttctcagtgactattaatgatttggccttctaatgattagcctccctgtccccagacttttatccatctttatcactatggctagttatcttgctaaacaacagatctaatcctagtaccccattatattaaaaaaatcttctatagctacagctttctctccctccaggtcagtatccatagcctgtcaagatgtggctttgataaaggacagaaggcagggaaattctgggcagaagagggcaggtccccattgaggacccaccctcaagccaaaaagcctggaaccatggcccaaagtgagaacttacatccctgttttccctcttgaagggtgccttttccaaaaccatccattaccccccacccaccccccaacctgtgcctataaaaaccccagagctcagctggcagaaggaggagaagcagatggatgtcagaaactacagttggacatcaaagagaagcggcttgactttagagggacagtttgacagcatagctttggagaggagtccagctgtggatggtcagactccaggggaagattaccttcccactccatccccttttcagctccccttcccactgagagccactttcattggcaataaaatcccccatatttaccatcttcaatttgttcatgtgacctcattcctcctggatgctggacaagaacttgggtgccatgcgtgtgggtgaaaaaggctgtcacactgaccctccactgagctgttaacacttaagccatctgtgaatggcaaagctaaaagggcgctgtaacacttcctcatgggcaccctcccctagaggctgctgcagggcccgtacggtgttcactcttgccagcactcaaaaatgctggccccagctgctgcacctgctcacctgtgctcccccttccatgaggggtggaccagcgagtgagtggagtttgctcccctccagttcccacccacgaagggatcagggaaatatcctccttcagctccagtgaggcacagtggtatacacctatagtcccaactactgaagaggctgaggtgggaggatctcttgaacccagaagtttgaggctgtaggcactgtggttgtacctgtgaatagccactgccctccagccttggcaacatagcaagatctcatctctaaaaaagaaaaaatatatatgatgtggctccaattcactgatctagcctcttaactgaattccttcctcctggctgggcacagtggcttatgcctgtaatcctagcactttgagaggccaagacaggagaattgcttgagcccaggagttcaagaccagcctgggaaacatagtgagacttcatatctacaacacattttttcaaaaagaattttttcctccctgctccccaccctacccccttgcaaccttatttactcttcggcctctggccctctcgctatgtctttctcagcttcatgcctttgaaaatactctttctatgcctggaaagcccttataaacctggaaattcctattcttattcaactctgagccagtccattttagtggcttagttcagaggctctagatttaaattgcaattctgtcagattctgtctgctttgccaacctcaatcaagttatgtactatgcctcagtttcctcatcagtagaatgaaaataatacagtagtgcttttttcatagggttgtagtgaggattaaatgagatgaagcgtataatcctcatgtacataacacagtacatactatatgtgttgcacatagtaagtgctcagttctttttctttgcattattcttagcacataagtcaagttacatttgctctcccttacgcaaggtcaattgttcttttttatgtgtttacccgttactttgttcatgcatttgttataaccactgccatcataaagcaacttgctatctttgttcataaaacaaatcccagattcactgagctcaaagtgagagaaggaaactttgcattatgtgcagttcctatgcttttctccaaatttcacatctccgttggggatctctcactagttatccttgccatacccccacaccagccttacaattttgcattatgtttcctacatcatgattctaaacggtcctcctgttcgctttctctccatcccatatcgttgcagatagctatttcctctttttaagacagaaacacatttgcattttgcctaagctacatttgtaaattttacagtattttcgaaagacacaatggaatctaggaaagatgcaacagataaagagattaactggccaatttttgagagcaccatccgtaaagtccacgaacaagtgaggcttccttgtcggagaaagcaattcagtcaccataaatgatcattcaagcctgatctcattccctcttgaaactggaaattgaaagcttgttcctctgacagttgtgttgtcagtggatatgcccagtgtgcaaaggactggacaaagggcaaaagtacacatatcccatctggaattctgagtcatccctgagacatcattttggatttgtctactgagatgaaattaaaacatgagtaatcaagcccacacttcttccccctcaaactcatctctttggtatcatcaagaaaatcaaatgctaatagccattgacctcctaattctagtgctcttagctatgataaaacagtcattaacttaatctaaatgttgcaaataaaggagccccatcaaagctgaagccccaaaattatacaaatgagttaactgggaaggcatgggggaaacaacagttttcataagacacactctaaatctagtttattctcttaggaagacttttctcatcaatagagagccacataaagatgccttacctgcctttcacggggactatatcaattggctgtactgtcactcactccaaaactctcaaaatgcctaacacagattcttgattttattgattgcattagatgttacgttttctaaattttcagcaccctggaggtcacctcaggaaatcatgcagtttttgaatgattttccttagaaatacacgtgtagctatacatatgcccatgcgttatttaatcagttagtgaaaggaggaaaacagcatttctattattgacctttctcaatctctgaggagactgtatgtcttgcctacagtccaggattgaaagcaaaagaaaaaggcactgacaaaatagcattttattttaatagcacattatggagagacaaaaaaaaaaaaaaaaaaaaaaaaaccctgggatttcctttgtctaagtagaattgacgtatgggtgagatcagtctctattttactcagtacaagtgcacacatatttatgtacacacatataattgtcatctttgggccgggcgcggtggctcacgcctgtaatcccagcactttgggaggccgaggcgggcggatcacgaggtcaggagatggagaccatcctggctaacacggtgaaaccccgtctctactaaaaatacaaaaaattagccgggcgtggttgcgggcgcctgtagtcccagctactcaggaggctgaggcaggagaatggcgtgaacccgggaggcggagcttgcagtgagccgagatcgcgccactgcactccagcctgggccacagagcgagactccgtctcaaaaaaaaaaaaaaaaaattgtcatctttggaagctaagggccctgtatcagagtatcagaatatacctatatccaggatgcaatgttctccagttttgcattaacatcagctacaaggttcactgccatctaagactaatcaacagtaatagctaaaggacaaaggtcagttcctgagagatatgcctaaattcatctggctatatcttctgttcctcccaaaccctaaccccataaattcttcattgtttagaaggattcatattttttgtttgtttttcatattcccattttattggctggggttagaattgcaatggcagcaaaaaacacagaagctatctacagtggcttaaataaatagagttttatttatctccaatattaagatgtctggaaataaggtgctttgggcccaacagtatcaggactggcatctgtatattttttattgacttttcctcatgcaatatagcagccaccattatttcacagggtgaaaaagagaaggcaaaaagggtgtactatctgagtcttatcatttttataaagccaaaaatttcccagaaaccttttttgaaagacttctacttgtatatcattgtgtagaactgtgtcacatgacagccaccaacaaaaagatggctagggagaagtggttttcaacaggtattgaagtagctaaccggcagtgtctgccggtcttcagttataaacaccagcagctaactctggctaattcaagtcagggaaaacaaaggggatggggtaggggctctttatttaaaagatactcatagaaatgaacgaagtaatttgaaaactaggtctcagaataggacatgaagtataagagttctaaaatctcaaaagcaggaacacatgcatcttctttttaagtgttgtctttgaaatactaagctccaaagtctttccaaccttgtattattttcttcctttgtcagcttcctgagtggcagagtctgagtaacctatggggtctttgaactctttaggggaattgaggaaggcaaaaaggtaccatgattggcagctctactagagtcacaagaaatatggggaaagcgattcctcaaaggaaaaacaaaaacagaaacaacaaccaggcagttagtagaaggatgaaatactggacccacaaagacaacatatgtcttctcaccacacttggtctctctctctctctctctctctcacccttctctctctctcatagtaatgaaactaaagctgcaaaactaaggcctagctattcattgtgatccttatgagatcataaaaaaaatctgtatttaagtggagaaaaataaatggaatatcaactttaaaaaattttttttgagacagagtctcgctccgtggcccagactggagtccaatggcatgatctcagctcactgcaacctctggctcccgggttcaagcaattctcctgcctcagcctcctgagtagctgggactacaggcacgtgccaccacacccagctaatttttgtattttcagtagagacagagtttcaccatgttggccaggctgttccgaaactcctgacctcaggtgatccacccacctcgacctcccaaagtgctgggattacaggcacgagccactgcacccagctggaatatcgatttaattgtaagagaaaaatgcactagtttaaaaatgtgtcctctttatcctcaggttttaaaaatatttttaaggtagtttagaaaaactgaagtgattatttgataaataaatttcaaatgctatcaatggaacaagaatggatattagatatcctgctaacaaggatcatatttttacaagttgtttctccaaagagaacagagctacagctgagattctggtgcgcataaacctttccatcagagctgtagtcacctaacaattcttatatcacaatcttcatatctcaatcccttttccaaataacttcatctttcttaagttgcatacaaatgttataatctaatatttttgagatggatatcatgtgtcataaaaagaaagccattgtaatattaccaataccaagtattagcaaatattgacatagctttagaataaaaataaacagagctcaggttctggctctgccatagctagctagatttatcttaagacttcagtttcctcatatacaaaatgttgatagtatcatcatcttgtaagccttgttgtaaagagcaatttagctaacagtaacagtgtttaacatgcataaagtgaagactcctttctgggctgataagaacgctagtttattcatttgcttatttctatatttttaagcttagagtctgaaaattttcagagtctgggagtcaacgtgtggggtgtgaattggaacttcaccacttactaacaactcccttttgtagtgcttccatttatttatctgttcaataggagtaataatagcactcgctcaaagagttgtctgaggattagatgagacaatgcttgcaaaatgcaaagtggagcacctggtgtatagttggtattcaataatttctagttgttgatatgatgatgacgatgatgatgtattctcttgatatgtgaatgctcatcacaccatcctatggaatatttgattttaagaaaaagttgggtttgttttttttttttgtttttttttttttttgagatggagtctcactctgtcgcccaggccagagtgcagtggcgcaatctcggctcactgcaacctctgtctcctgggtttaagcaattcccctgcctcagcctccagagtagctgggactacaggcgtccgccaccatgcccggctaatttttgtatttttagtggagaccgggtttcaccatatttggccaggctggtctcgaactcctgatcttgtgatccacctgcctcggcctcccaaagtgctgggatgacaggcatgagccaccatgcccagccaagaaaaaatattttaaacaagttaagatcatttactatactgtgccctaagatgaggtgaacatgtagatcatgagatctaattgattttagatgcagttcagttttttaaaagaatgacctgctttccatattaaaatttcaaaacaatgatatgtggagatgatgacagaatatggctgaatgaggtaccttgttatcctcaaccttttggctcagagacctcttccttgctggaaactttcctaaccttttaatgatttattaacattttgcatgcactctttatacctttcattaatgactagttcactgcaaatttttctttgctttatttcctattcttggtgtgacattcattctctatctgtttctatggaagcttttgtgatgcctcagagagaaagaattctgagtctttgaaataatgaaaacattactaaaccataaaacctagatttcaggagcctaatagaggattagagctttattacgtacagccatcttacagtttagccttcaagtctcaattgtggaatgatcttttgtcctttctctccagtgtgcatgtgtgcatacacatatagacacagttcgcgcttcagtcatataaatgggaagccacaaagcttcctagagtacccagatgcagaattagaagacccaatcttgacaccagggtcaggggatctgtggtttggggggacttgtgctggctatattgttgtcacagcaggaacagtttgtgtcggtatagaggctttaacttctagtaaagggatatataatgaaaatgtaagcaaccatcgtttatttttctcacataataggaatttaagagaaagatatacccaaaattggtttattagctcaacagtttcattcagaatccaatgtctttccatctttgcatttgctatccttagcctttggctttggtctttggaattgtcacgcgatggttataaaatggctgccacactccaggaattgcatcatgacagtgtgaatggaaaataaaggaagagtggcagttcttgtcatgtttcagaagcaacagcatgtctccctaacatctctttggccagaactaggtcaagtagctgcatctacctgcaagggaaactaagaaattgactatcagtgctttttaaacttttttttgtgtgtgtggaaatagataatcactagagaaaaaagggagagtggaatggttgttgatgaggcaaccaacagtgtctaccactctatttataaaccttttcttgatttttcctactaaatgtgtggccgttttttttgcttgctttttgttttttgtttttgagatggagcctcactctctcccccaggctggagtgcagtggcgtgatctcggctcactgcaacctccgcctcccaggttcaagcaattctcctgcctcagcctcctgagtagctgggattacaggtgtgtgccaccacgcccagctaatttttgtatttttaggagacatggggtttcaccatgttgatcatgctggtctcgaactccagacctcgtgatccgcccatctcagcctcccaaagtgctgggattacaggtgtgagtcaccgcacccagccaatgtgtagccttttagttcaaggacctttcattataaatcttcatagtccaaacacccggcatattgtctggcacaaaataggaagaaatatttttggacgtgccaaggaatttgcaagacagtgagacaaatagccagtaaaaatgttagcattaatatattattaaaaatagtgagaaatgctccaggcgcagtggctcatgcctgtaatcccagcactttgggaccccgaggcgggcggatcacttgaggtcaggagttcaagaccagcctgaccaacatggtgaaaccctgtctgtacttccagctacttaagaggctgaggccggagaattgctggaacccaagaggcggaggttgcagtgagccgagatcacgtcactgtgctccagcctgggtgatagggcaagactctgtctcaaaaaaataaaaataaaataaaaagaaaaatagtgagaaatgttatgaagacaaagaataggctactttggaagaataatagtgggaacttcttcatagtctaggaaggcctctctgaaaaggatatatttaagctaaaatctgaaggttaggtcagtcatatgaacagggaggggaatggaataatattttcaagacaatgacctaaaaggaggcaagtatggctaggagctaatgactgagggggtgagtggtacaggacaaggctggagagtttattttatgggtaagcagagaaataatataatctgacgtacctgtgaaagtacacctgagctgatgtacctgcaaaacatcatacaatctgatggacctgctgtataaatgagagattgaatgtggcaagagtagaagcaaagaggccaggtaagaggcatttgcagttgtcttgatgaaagaaaatgactactgggagtaagatggcggcaatggaaatagagagaaatgaacagatttgagatgtattttcgagacaaaatctgtatgacttggtgatggattagatgtcaggcatgagggattgaggatgactcccaagttttttttgtttgatcaacttgttgtactgtttgctgaggtgataaagatggaggaggaagcagatttggaaaagatcaacagttcagttttagacatgttcagtttgaaatgtgtgtgatatgtccaagtgcagaagtcaaattcaattatagctcaaaggagagacccgagctagaagcgtaaatgagaaaaatattgatacaaaatggaatttagagcatccagaatggaaatcacttagcatgtaaagagggaagggaagatggcctaggaccaaaccttgataaacttcaagaaaaagaagtcaagcagaggtaggagaagagaagtcagtcaaaaatcaaaagaatatgacatctcagaattcaaggatgtgaataaatgtgtaagtgatggatggctttcggtctgggctttttgttttttttttccattttaagttccaactttgctacaatccggctacgaatcccacaccctcccaaattatctgaggatgttaattgatacttgatcagaaagcagtgatttttaaaatcatatacttctaaattatctgagatatgaagcaatgagatagggaagtggctgaaatatgtttctctggctcagctgtcatgagggcttgctctagaatggcactcaagcacatgtttatccactgagctctatatcatttattccattagctgaagaaggaatctctcacactctaacttcagttctgttggacatgggaataaaagttagatgtatacagactaaactaaacagatggtagaaaaacaaaggattcttaaagtatattggagaaatgcatttctatggtcaattttcttgaatatcctaagatcaggtttcatgtatataattctttacatttcacaaagcacctttagatgtgtctattccatttaaccctcatcctaactgtgtgaagtagggcacagaagtgtagaaatgattttttaaaactcactaagctaatcaatggataatctgtgattataatagaatctgagtttcggcatctttatcttattccttactgcactatatctggaatggtaaatattgttcatctcacaagcaagctcttattgactgatatcagctgcctagagtggtttattgtaaaagagcataaagcaaattggggaagactacaatacagtgccataggctgattagtaatttctaccattggtattaaatgagaaaataatggtacaagtgctttacatttgtctgccattcctaaactaaggcacctcctgttatttataaggaagaatattctgagaagtttaaaagtctcttgttaaatcatttgatgacgttggataaaatggcttaaaataagaatatgcctgttgcacaaataatctacactcccccaagataatgaataagtcagctggagcatctcaagtttcaatatgtagaggatcaaaatgaaatagtcataaaaccccttgcagacatttcttgggcaggcaaactaatttcctagtaaaagaagttggaagttggacaaattgtatatgggaactttctatactacttttgcaaattttctgtaagtttaacttttcctaataggatgctgagattcagctcttccaatggtctcaaatgttttttggttttgttttgttttgttttttgagacggagtctcactctgtcacccaggctggagtgcagtggcgtgatcttggctcactgcaacctccacctcacgggttcaagcaattctcctgcctcagcctcccaagcagctgggattacaagtgcctgccaccatgcctggctaatttttgtatttttagtagagacgggattttgccatgttggtcaggctggtctcaaactcctgacctcaggtgatccgcccaccttggcctcctaaagtgctgggattacaggcatgagccaccgctcctggcctcatttaaccattttgactttcactttttctgtcttcaaaatgaggtattgagctaggtaaacttaatgtcttttttcgctttaattatctaataattctgtgattctcaacttggtgtgttaaaccagattacacctaagaaaccctgaagactttttagctaggagtttaaatattcacttagtcattcaattaatatctattgtgggtctgttatatgccaggcgccattttaggtattgataataaagcagcaaacaagacaaaacccctgccctcaggagagcttacattcttgtaaagaagacagatgataggccgggcgtggtggctcactcctgtaatctcagcactttgggaggccaaggcgggtggatcacgaggtcaggagatcgagaccgtcctggctaacatggtgaaactccgtctctactaaaaatacaaaaaaaaaattagccgggcttggtggtgggcacctgtagtcccagctactcgggaggctgaggcaggagaatggcatgaacctgggagctggagattgcagtgagccgagatcgtgccactgcactccagcctgggtgactgagcaagattccatctcaaaaaaaaaaaaaaccgaaaaacaaagaagaaagatgataaacaagtacacaattatcatataacaattttaaatagtgacagcatgttgaaataaataaagcaaggaagacgctagagagttgttcatggaaggaattgtcattttatataaggtgatcagggaaggttccactgaggaggtgacatttgaggaaagacctgaaagaagtggggagggagacccgaaagttcatgaggaattgtgtcccaaacagggcaacacataaaaagtccttgaggcaagactaagctgattatataacatttaaaagaattaggccaggtgtggtggctcacacctgtaatcccagcacttttggaggccaaggcgggtggatcacctgaggtcaggagttcaagaccagcctggccaacatggcaaaaccgcgtctctactaaaaatacaaaacttagccaggcatagtggtgcatgcccatagtcccggctacttgggaggctgaggcaggagagtcacatgaacccaggaggcagaggatgcagtgagccaagattgcaccactgtactccagcctgggtgacagagcgagactctgtctcaaacaaaaaaaaaaagaattaatttacatatcatgagatcatctagtctaacacccttactagacaagttcaaaaaggttaagacttggccaagatgacacagctatttaatgtgatatctgggttagaattcacctcatctgaattcctctcaaattgtgctctttgaggtcaatgtgccttttaaaaaatgacagaaagcatggctgtagatttcagatcataccaaatttgatggaacaatgaccatttttagcttcctatagagtctaagacttgaacttgccaagggagtcacagctggatttgtaagcatcaaatccacaaatgtacttaatgtcaaccaaggattttgtgtcacctgtaatgctcccccaggaagcccccaagtccactagtcctaatcactgtgtttggcttcataacctgttggcccaaacattacgcaaaaaagagcaatattcccaaggtggtcatgttagttgtggtgagatgtcaaccataagtagatctgaccgaggaaatgccttaaggaagcagctcaggaacacctgagtatatgtgtctagaatgaagcctattaaaaaaactactgcagagctaaagacagctgaaagccattatgacagtcacaactacttgatagattgaaaccaaagagttcctttgtgattagatagatcaggactctaaatcatgtttttacttcatgtgttcattcattcatcatacagtcagtgattcagtaaacaatattgagcatccattatgtgccaagcactgtgttaaattctggaaacacagagatggattagacccctgtccccagggagcataaagactagcagagttagacctccctcccatatgaagaaattaaatgaggtaaggcattaaaagtgctatgattacataatacagaacccaaaggggaaggcattttctgaaaaacagaaaactgaaaataccagcttttcagcctcacacagacataggaaaaccaacccccatcaacatcatctcttcttttttttttattattactatagtttaagttctagggtacatgtgcacaacgtgcaggtttgttacatatgtatacatgtgccatgttggtgtgctgcacccattaactcgtcatttacattaggtatatctcctaatgctatccctcctccctcccctcaccccaaaacagtccctggtgtgtgatgttctccttcctgtgtccatgtgttctcattgttcaattcccacttatgagtgagaacatgcaatgtttggttttctgtccttgtgatagtttgctgagaatgatggtttccagcttcatccatgtccctacaaaggatatgaattcatccttttttatggctgcatagtattccatggtgtatatgtgccacattttcttaatccagtctatcattgatggacatttgggttggttccaaatctttgctattgtgaacagtgccgcaataaacatacgtgtgcatgtgtcttcatagcagcatgatttataatcctttgggtatatacccagtaatgggatggctgggtcaaatggtatttctagttctagatccttgaggaattgccacactgtcttccacaatggttgaactagtttacagtcccaccaacagtgtaaaagtgctatttctccacatcctctctggcatctgttgtttcctgacttttgaatgatagccattctaactggtgtgagatggtacctcattgtggttttgatttgcatttctctgaacatcatctcttaatataaaaagcataatgtgctgatttcacattgcatgcctgtatcaaaacatctcatatgctctataaatatatacgcttaatgtgtacctacaaaaattataagaattttttttaaagcaacaataaatatcttcattagtcaaccaaattaaatctattaatatatccatgtttgtgaacaggatggccacagaaccctgtggatgcttaccacttaaacatttcctgaaacaaatatgtttccaaaacatcttgcctgtctaatctgacaactgcagacatcctaactaggctctgaaggtgctctccatagcactgatgttattgattcagttgttaacagcgcaggcataaatgactgatgataactctctaaacgtcccttcctactgccgttgaaatggctctgggctttatccaagcagggctgctaaatgaatagtagatgtaccagcagaggagaaattggtcctgaggtgaattaactctcctgaggtagatttgtttgtgcttccaacaacctgtacgttaaaccttgtgaaccttcatgtaggaattttgaggagaaatgggcaatttttggaaagcctaatgttttatcagccgctttttcttctcattgagacctgtgtattctcaagggactttggaagtttgccattttaagaacagacttgatgagaattatttgaagtcctccacgtttccatttatcagttttcctaatacagacatcctacgcacatcgttgaaagaatgttctttttgcctcacaggtagatcacaaaagtgggcccataatcattgggtagagggtttctcagctctgagttaaattgcagctgggtattgtttttctgtaataggatcttctctgagtgaatggtgaaacatgcccatttttgaggtcatgagagcagagctttccacatcatggacagaaaagggcaaccggccatggtttcagttatacagggagaggaaacaataggttttgtctctgctttgctattgcttcaacagcagcatactgttggacactcagacattagggcacaatttagacttgtttcacagctgtcatttctttcctcaaaaacaacaaacctgcatgggggaaatgagtctacatttcagggtttttcaagaattgataacataacatgtacttcaccatgaatttatattccacaggtccctgttctcttctctggtcatcagagtacaaaatcacaaccaaaaagcaagaattgatatctatgaagctaaagtagtagtagtagtagtagtagtagtagtagtagtagtagtagtagtagtagtgaagcaggatattaccctgatcccctcgcgggcgggaactggactgcatagccgcttcggtgctggcaggggcagactccactggctcagtctcactgagttccacccctcatgggagaggaagcacaggtgagtgggtacaggagccagggtgagtgcttttgggcgccagcaggaacaaaactctgtgtgggccccatggcagtgtctaggagggtgcccgcgacccttgaatccccagaaggagtgttacagggcccttttatctttgccatctgcagatggcttaagtgttaacagctcagtggagggtcagtgtgacagccttctgtactcgcacttgtggcacctcagatcttgcccattttccaggaggaatgaggtcacacaaactaattggagatggtaaatgcgggggattttattgctgatgaaagtggctctcagcaggaaaaggagctgaaaaggggacagagcaggaaggtaatcttcacctcgagtccagctgtccgcaatcagactcctctctgaagctatgctgccaggctgtccctcggaagtcaagccacttctctccaatgcacaaccatagtttccaacatccagctgcttctcctctgtgccggctgagcctgggatttttacaggcacaggatggagggcagggtgggctatgggtggttttggaaaaggcaacatttgagcaggaaaacagggatgtaagttctcactttgggccacagttccaggcttttaggcttaagggtggggcccttgccagagacccgccctcttctgtccagaatttccctgcctcctgtccctatcagtagtaatagtagtagtagtagcagcagcaacagaagtaatactaactactacataccaagcattatctacgtacttcatatctattcaccaacctaattgttacaactttcactcgcgtccgtgtgaagagaccaccaaacagtctttgtgtgagcaataaagctttgtaatcacctgggcgcaggcgagctgagtccgaaaagagtcagcgaagggagataggggtagggccgttctataagatttgggtaggttaaggaaaattacagtcaaaggggggttgtcctctggtgggcaggagtggggatcacaaggtgctcagtgggggagcttttgagccaggaagagccaggagaaggaatttcacaaggtaatgtcatcagttaaggcaaggaccggccattttcacttcttttgtggtggaatgtcatcagttaaggcaggaacaggccatttaaatttcacttcttttgtgatttttcagttacttcaggccatctggatgtatatgtgtaggtcacaggggatatgatggcttagcttgggctcagaggcctgacattcctgtcttcttatattaataagaaaaataaaacaaaatagtgttgaagtgttggggcggcgaaaattttcggggtggtgtggagagataatgggtgatgtttctcagggctgcttcgaggtggatcaggggtggcgtgggaacctagagtgggagggattaagctgaaggaagattttgtggtaaggggtgatattgtggggttgttagaagaaacatttgtcatgtagaattattggtgatggcctggatacggttttgtatgaattgaaaaactaaacggaataagagaaggagaaaaacaggtattaaaggacgaagaattgggaggacctaggacgtctaattagagagtgcctaaggaggttcagcatagccttgccagcaaagattatttactttaagagttaagagtggtggtttggggatagcaccaagagatatcagctgtgatggcttggagaaacagtgtaaaccagcagtgtaaacaagagcagggcatttatgactagttgagactggtgaataggagtatgactagacagaagataggagggatgacaagttttttggggtgcagtctaagttggtctggtgtctggaatgagactggggcctaataaaaaggagcgtccatacaggagcttaaatgggctgtaccttgtagcattctgaggacaggcctgaattctgagaagggcaagtggtaaaagtattgtccagtcctttttaagttggtggctgagcttggtgaggtgtgtttttaaaagaccattagttcactgaatactaagagcctgagaaactgcttgggtgatttgactaataaagtccagtctgttataggaccgtatagaggtgggaaggccaaaccgaggaattatgtttccctgtgggaaaggcctctacctatccagtgaaagtgtctacctagaccaagaggtattttagtttcttgactcggggcatgtttagtaaagccaatttgccagtcctgggcgggggcaaatcctcgaacttgatgtgtggggaagggagggggcctgaataatccctgaggagtagtagaatagcagatggaacactgagaagttatttctttgaggatagatttccacgatggaaaggaaatgagaagttctaagaggcaggctagtggcttgtactatagcatagcctgcctttgctggtgtgtggccattaggcctggtggaactgccatcaataaaccaagtgtgatcagggtgaggaacaggaaagaaggaaatatggggaaatggggttgaatgtctggtggatcagagatacagtcatgggggtcaggcgtggtatcaggaataatgtgggaggccggattgaagtctgggccaggaacaatggtaattgtgggagactcaacaaagagtgagtacagctgaaggagccggggagcagaaagcatatgcgtcaggtgtgaggaagaaaatagattttggaagttatgagaactgtagagagtgagttgagcatagtttgtgattttgagggcctctaaaagtattagggtggtggcggctgccgcacgcagacatgagggctaggcaaaacagtaaggtcaagttgtttggataaaaaggctacaggacgtgatcccagtccttatgtaagaatcctgactgcacagccctgcacttcagcggtgtgtaatgaaaagggttgggatgagtcagggagagctcgggtgggagcagtctctaaagctgtcttcaaggaatggaaagaggagtggggaaaggatttaggatctatggggtcagctaggtttccttttgtgagtttatataatggttttgttaggatggcaaaaccaggtatctaaagtcgaaagtatctaaccatgcctaggaggaaaaaacttgttgttttctagaagggattggggtttgggagattagtcagacatgatcagcagggagagcacgtgtgtttttatgagaattatgccgagataggtaacaggtgaggaagaaatttgggcttgactgaagtaatgggggctgtctgtgaagccttgaggcagtacagcccaggtaatttgctgagcctgatgggtgtcagggtcagtccaagtgaaagtgaagagaggctggggtgaagggtgcaaaggaatagtgaagaaagcatgtttgagatccagaacagaataatgggttgtggagggaggtattgaggacaggagagtatatgggtttggcaccacagggttgataggcaaaacaatttggttgataaggtgcagatcctgaactaacctgtaaaccttgtctgcttttaggacaggtaaaatgggggaattgtaaggggagtttataggctttaaaaggccatgctgtagcaggcgagtgataacagactgtaatccttttaaagcgtgctgtgggatgggatgttggcattgagcggagtaagggtgattaggttttaatgggatggtaaggggtgcatgattggtcgctaaggagggagtagaggtgtcttatgcttgtgggttaaggtggggagatacaaggggagatgtgaaggaggctttgaactgggggaaaaggcggcaatgaggtgtggctctagcctaggaatagtcagggaagcagatcatttagttaaagtgtctcggcctaatagggaactgggcaggtggggataactaaaaaggagtgcttaaaagagtatcgtctaagttggcaccagagtttgggagttttaagaggtttagaagcctggccgtcaatacctacaacagttatggaggtaagggaaacaggcccttgaaaagaaggtaatgtggagtgggtagcctccgtattgattaagaaggggacggacttaccctccactgtgagagttacctgaagatcggcatctgtgatggtctagggggcttctgaggcaatcgggcagcgtcagtcttcagccactaaaccgagaagatctgggaaggagtcagagagccttgggccagagttccaggggctctgggagtggctgccaggtgagttgaacagtccgattttcagtggggtcctccacagatgggacatggcttaggaggaatcccgggctgcgggcattccttggcccagtggccagatttctggcacttgtagcaagctcctgggggaggccattctggaggaacccctcgcagctgcagttcaggcatttggagttcttctgtgctggagatatggctggggtttgtctcacagtggagggaaggaattgcaactcagaaatacattgctacttggctgcctctactttattattgtacaccttgaaggcgaggttaattaagtcttgtggggtttgagggctggaatttaatttttggagtttaatgtcgggagcagattgggtaataaaatatatattgagaataagacggccttttgaccttttagggtctagggctgtaaagcatctcagggttgttgccaaacgagccatgaactgggcttgtttttttatttgatgaaaaagagcctaaacgctatctgatttgggataaagaaaaaggagcattaaccttgactatgcctttagctccagccacctttttaagaggaaattgctgggcaggtgggggagggctagtcatggaaggaaactgtaagccggaccgggtgtgaggagcggaggtgataaaaggattatagggtggaggagcagaggctgaggaataattgggcctggcgaggaggggagaggtcagatgggtctgtagaaaaggaagattagaaagactgagcgatgcttggggttgggactgaggggacaggtgggagggaaagaaggaagatttggaaggagttgcattgggaacagagactggggaggggcagatgtgtaaaagaatgcctggacatcaggcacctcagaccgtttgcctattttatgacaagaattatttagagcttgtaggatggaaaaattgaaagtgccgttttctggctatttggaactactgtcaagtttgtactggggtcaagtggcatcgcagaagaaaataaggcatttaggttttaggtcaggtgtgagttgaagaggttttaagttcttgagagcacaggctaagggagaaaaaggaggaatggagggtggaaggttgcccatagtgaaggaggcaagcccagagaaaagggagtagagacacggagagaaggggtggggggttcttgtcccccagaaaagcggagaaggggtagagacatggagagaagggttggggggttcttgcccccgagaaaagcggtacttgccgctaaaggtgaaggaccaaggcaggcgtccccgtgtggtcagacacctctgaaatgtgggtgaataatcaggcaggcatccccgcgtgattaaataccaagggaagactcttccgagtccgtgaccggtgccggagttttgggtccacggataaaacgcatctcctgtctctaccagaaaaggaaaggaactgaagttaagagaagggagagattgaagtggggcgccaagattgaaaggagaaagaggttgagggatagtgagaggttggaggagagagtaaaaagaggccgcttacctgatttaaaattggtgtgatgttccttgggctggttagtctgaggaccagaggtcgtaggtggatctttctcacagagcaaggagcaggaggacaggggatagatctcccaagggaggtcccctgatccgagtgatggcaccaaatttcatgcgcgtccgtgtgaagagaccaccaaacaggctttgtgtgagcaataaaactttttaatcacctggatgcaggcgggctgagtccaaaaagagtcagcaaagggagacaggggtggggccgttttataagatttgggtaggtaaaggaaaattacagtcaaatggggggtggttttctggcgggcaggagtgggagtcacaaggtgctcagtggggaagctttttgagccaggatgagccagggaaaggaatttcacaaggtaatgtcatcagttaaggcaaggaccggccattttcacttcttttgtggtggaatgtcatcagttaaggcaggaacaggccattttcacttcttttgtgatttttcagttacttcaggccttctggatgtatacgtgcaggtcacaggggatatgatggcttagcttgggctcagaggcctgacaacaacgatcttgtagataggtactgttgtaattcccagtttacaaataagaagactaaggtatagagagattgagtaatttgcccaaagcccacagctagtaagaagccaagattcaaacccaggtaatatggctgcagacctggtaatcctaaccattacattaggctgactctcgatagttaacttatttaagctagtgttaatcacatcttaacaagtttgagtaataaaatcttaggttgaaaggggccttcaagatctagtctaaatcctttcaggagttcttccacatttctgctagaaaacactttggcctaggcttaaaacttagtgatggggaactcctcactttgtaaagcagcctgttcagttcacaaacaccctaataattaggctgttatctcttgcattgagctgaagttgatcttcccataacctctgcctttctgtctatatgtatgctttggaaatatacacagtaagtgtaaaccctcttggcaaagacagcccttcaaatacttgggaggcattcaattccccccgccacctcccgctctactctcactaccaagtctttagaatagagtacaggtatcaaaatcaaaacaaacagggagtagaaacttagtgccagactttaagtattttttacttataaaatctttttgtgtaacgagtagagcaactcctaactgcatatatgtactaagtttgcaaatggggcaatttgtttttccccatgcactggcatcagaggtggtaaatgctggcctgtcagattcaatgcattttgctgggttagaaccgcaagggctttccaggggaccaagctctctctgctgtaatcattaaaacctgcagaatcctgtgtgactctggggagaagcccagtgctcttggccctcatccaccctcactaggaaagctgcttaaaactaggacagaagaaacaaccactggcttaggatcagtcctcagacctgccttggcactaccccttttattccaaattttgcagtggcacctccaacttcttggtcacgttttgtaccttgtctgtttcctcatataacttcattccaaattccaacccatgctctgacatttcctctccattcttgctagacaggaatttctggatattggatattggcccctgcccataccctgactctgtatattcttttgtcctgctgaccagtttgagcttctgaataacaaaaactccccaaccactttaaagtcctctactttagcttgatgggtccctctcctgtattttctgaccttgactctgctctctgtacaaatagtaattacactcacccccaagcagagaatctgtgtcaaaatccatcaggatatctaagcacatcattatatctgtcaacttccccagactcctgatctcaatcccttattttcaacaacctggcaccgacagagtataatttcttttgtatcatgatgcagtttgatgtgcttttcgaaaggttatggtggtgattttaaagagatctgttttgttagaggaaggaaggaaaatagtgctgtttgcttccatgcagttcctcagagcctatgccagggtgatttcagctcatgagagaatctaaagtctaaagagatgtgtggagattagaaacattggtgtaaaaaatcagattacggagacgtaatatccagggtgtcagaggaggcagggagcttcaatcatgtttgaaactataggtcccacccaacaggatgagaaaatacaggagaagccagaaaaggtacctgcttgtgggtaaaatcaattaaatggaatcaatggtatggtagccatcatttctttcttttcaaattgtggtaaaaacacataatgtaaaatttaccattttaaccattttttagagtatagttcagtaatgttaagtatattcatgttgtcatgtagtggacttgcagaactttttcaccttgcaaatctgaaactgtacccattaaaccacttctcatttcctcctttcccccagcccctggcagccatctttctactttccgtctctatgcatttgactattctaggaacatcatgtaagcggaattatacagtatttgttcctttttggactggcttatttcacgtagcataatgtcctcaagtatcacctattagctgtcattgcttgaacacggttttctgccaagcacatgatctcgttttattcccagcacaactctcaataacaactgtgtaccttttttccctttcacagattaggaataaaaggctctccaagactaggctcagaagcagaagcagttggagagttgcttgcagaaggattattgtcatactgggaagtgctctcaggatttacacctctaagaaactgaaaggggcatgactgcgcagaggaaaagctggttcaccatgcagttgcaattatggctgcagcaggagcatgcagggaagctctggagtaggtttggcctttcagagttgtccccagtaaatcaaatgggtgaagactttaacccatttatgctggaggttgcaaaaatgttttgtgaaaagtcagaccttggcgatgaccttgagcagtaggatataaaaaactcccacaagcttagcgtcccaataatggaacactaggcataaatgagttaatccctgcatcagccagtcattggccctaggtctctccctgagggaggggatgtagctgtgtgaggcagttccctgagggcacattccaatgaaggccccagctgtgagccagcagccaataaggcagcaggtggcccatgcatgcaaaggccctaaagaggaggtccagggtggagcgccacggtgtctactacagatgctgaaagagtaaatacattttatttatttatttatttattttattatactttaagttttagggtacatgtgcacaatgtgcaggttagttacatgtgtatacatgtgccatgctggtgtgctgcacccattaactcgtcatttagcattaggtatatctcctaatgctatccctcccccctccccccaccccacaacagtccccagagtgtgatgttccccttcctgtgtccatgtgttctcattgttcaattcccacctatgagtgagaacatgcggtgtttggtcttttgtccatgtgatagtttactgagaatgatgatttccaatttcatccatgtccctacaaaggacatgaactcatcattttttatggctgcatagtattccatggtgcgtatgtgccacattttcttaatccagcctatcattgttggacatttgggttggttccaagtctttgctgttgtgaatagtgccacaataaacgtacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgaccgccattctaactggtgtgagatggtatctcattgtggttttgatttgcatttctctgatggccagtgatggtgagcattttttcatgtgtcttttggctgcataaatgtcttcttttgagaagtgtctgttcatgtccttcgcccactttttgatggggttgtttgtttttttcttgtacatttgtttgagttcattgtagattctggatattagccctttgtcagatgagcaggttgcgaaaatttttctcccattttgtaggttgcctgttcactctgatggtagtttcttttgctgtgcagaagctctttagtttaattagatcccatttgtcaattttggcttttgttgccattgcttttggtgttgtagacatgaagtccttgcccatgcctatgtcctgaatggtaatgcctaggttttcttctagagtttttgtggttttaggtctaacatttaagtctttaatccatcttgaattaattttcgtataaggtgtaaggaagggatccagtttcagctttctacatatggctagccagttttcccagcaccatttattaaatagggaatcctttccccattgcttgtttttctcaggtttgtcaaagatcagatggttgtagatatgcggcattatttctgagggctctgttctgttccattgatctatgtctctgttttggtaccagtaccatgctgttttgcttcctgtagccttgtagtatagtttgaagtcaggtagcgtgatgcctccagctttgttcttttggcttaggattgacttggcgatgcgggctcttttttggttccatatgaactttaaagtagttttttccaattctgtgaagaaagtcattggtagcttgatggggatggcattgaatctataaatttccttgggcagtatggccattttcacgatattgattcttcctacccatgagcatggaatgttcttccatttctttgtatcctcttttatttccttgagcagtggtttgtagttctccttgaagaggtccttcacatcccttgtaagttggattcctaggtattttattctctttgaagcaattgtgaatgggagttcactcatgatttggctctctgtctgttattggtgtataagaatgcttgtgatttttgcacattgcttttgtatcctgagactttgctgaagttgcttatcagcttaaggagatttggggttgagacgatggggttttctagatatacaatcatgtcatctgcaaacagggacaatttgacttcctcttttcctaattgaataccctttatttccttctcctgcctgattgccctggccagaacttccaacactatgttgaataggagtggtaagagagggcatccctgtcttgtgccagttttcagagggaatgcttccagtttttgcccattcagtatgatattggctgtgggtttgtcatagatagctcttattattttgagatatgtcccatcaatacctaatttattgagagtttttagcatgaagggttgttgaattttgtcaaaggccttttgtaaatacattttttaaggtcacacaaatgacatatgggacagaacagtgtttaacttcaaaactcatgttctttctgctatactgggccttctctccgaaagaggcctaatttgcacactacagtcaagcttagaatctattcatagttaaaatgtggagtcaaagcccaggaactatgtccttcaattcatctttcattacttacctattccttatcattcccgctgacaccaaccattttttctgacccttgtcatgaggagtgaagttgtatcattgcagcagctttctacttgtactctatgcctaaaatctctccttcctccatctggtcagccaattgctgtcaagttaatcttgcaagaacactacttttgccagtttaatttcgcaaaactcctgctgtgtgccaggagtgtcccagacatcaggtagtctaagataagcgatagtctctgcccctaagccgtttgcaacctttggagagacaacgtcattatcaccaccagcacccccattaagctcagagctaatatatgccagatgagactctgccagtcactgtgctaaggacttgacatacgttatctcccttaattctaacaactactttctgaggtacctctgatgagtagtatcatttttagatacaaaagcagaaacttagcgagttaagtgctttgcccagtggctctcagttgagaaacgaggtagtcacaccaggcagtccaacttcagtacctgagttcttaatcatcatgtttacaactttggctcaacattgtcaccaagatcgggttcaaatacatccattatcaatattctttctgtctccttgtatgtccaaacaaacaaaacaaatgcttccctcctgatgaggaaagtctccaaatcttgatacctgctgtgtctggacagtttttcctgctatttgctgagtgctggaaggattccctcaatccagatgtgattgcagatccagctcaagctcagcgtcctccagggaacctttgaactaaccacccagaaacgagcctttcaccggacactactcattttcacatatctagatcttatttccccatctgaactgtaagtgtcttaagagctgattttgttgttttttaataaaaaataattcttagttttttttcttattaccaaaaaattattcgccattgaagccttctgaatttttaataagaaaactattggtatattgcttcaaaaagaaatctaagcttctagattcttgaaaagggatagtgacagaaccttagaattaatattcaatataactaatctgatgaaaattcagtcattgatacattactgagaactactagatctcagcatttttaattgtagattcacatggagttgtaagaaattatacacggactccacatacctttttaccgagtttcctctaatggtacacctgcaaaactctagttcaatgtcacaaccaggattttgacgtcaatattgtcagtatacagaacattttcatcactacaaagatccctcctattggccttttatagccacacccacttccctgccccccctacctcctacttccagcaactactagtctgttttccatttctttaattttgttatttcaataatgttatatgaatggaaccatacagtatgtaatattttgggatggacttgactcactcaacataattccctagagatttctctttttatatgcagcaagacttgtttcctttttatcgtgagttgtatgctatggtttggatataccctagtttatttaatcactcaccccttgaagacatctgagttatctgtagttttggactattgtgaataaagctaccaacattaatgtacaggtttttgtgtgaacataagtttttatttccctgagataaatgctgaagagtgcaattgttaggtcatatggtagttgaatgtttagttttaaaactgccaaacttttccgaagcgtctgtactattttatattccaccagcaatgtatgagtgatccagtttctctgcatcttcaccaacatttggtgttgtcattattttttatttttagccattctgatatgtgtgtaggaatatctcattgtgcttttaatttacgtttccctcgtggcaaatgctgttgaacaacttttcctgtacttgtttgccatatgtatatcctcctcattgaaatgtctgttcatgtcttttgtctattttctaattcaaaagtttttttatagttcggttttgagagttctttctgtatcagatactagtcctttcttgtgtatagggttttcaaatgttttctctctcatcttttcatcttcttaacaggggatgaaaaagaattttaattttggcgaggttgaatttatcgctttttccttttatggatcatgcttttgtgttgagtctaagaatactttgcctagccctggatcccaaagattttctcctgttcttttttttttttttttttgagacggagcctcgctctgtcgcccagcttggagtgcagtggcccgatcttggctcactgcaagttccgcctcccgggttcacgccattctcctgcctcagcctcccgagtagctgggactacaggcctccaccaccacacccagctaattttttgtatttttagtagagacggggtttcaccattttggctctcctgttttatatgtcttatagttttacattttatgtttaagtctgtgatccatttgatttttatataaagtatgaggtttaagttgaggtttattttttgcatatggatgttcaattgctctagcataattatttgaaatggctggcttgattattgaagtaaggtcagacttatttctctcctgggcttcagacccagccaccttctatgtttcttgtccaccacaacctgaatgtcccacagacacctcagacttaacatgtccccagcagctcattattatcctccttttgtcccaatccaccctcaacatttttccctccctaattgtgctgttcttatgaacgctacgcttcacccaattgcccaagtcaaaaattagggtattatttctgaatctacttttatctttaaatctaacatgatgcattgccaaattctgtcagctctatccccaagccatctcttaattcattcccttatttacacctcccttgactccaatatcttttgactcaaatgctacatagcctctaatttatctccctgatattgttcttgcttccgaatcccttttccacaatgcgcctatagtaatcctcctaaaatgcagatctgattaggtgactctccttattttaaagtctttcttattgttttctcctgccctaaggcagaagttccaacaaatcttgttatcagattctggattaaatcccggcctcagcagtgggacctaagatagtgcctgaatttccatgaacatttattgatgacaaagagggtcttaaataatgagtgatgtagactttccactgtcaacatcacagattctggtttttaatggtattcacatttgccttctccaagagtccaggtttaatgatggtgagacctatcctaagacctggctttgtagtgaggggttacctcatcacagaatcaagaagggacctcgggccgggcatggtggctcatgcctgtaataccagtactttgggaggttgaggtgggcagatcacctgaggtcaggagttccagaccagcctggccaacatggtgaaaccctgtctctactaaaaatacaaaaattagctgggcttggtggcacacacctgtaatcccagctacttgggaggctgagacaggagaatctcttgaacccgggaggcagaggctgcactgagccgagattgcaccactgcactccagcctgggcgacagagcaagactctgtctcaaaaaaaaaagggcggggggacctgggtgcaagtaattctaagaagcaggaataagagaacaagaagaatgaagcgacaaagaaagatgagcaattctctggaactgttgagaagtgtacagaagaaaacaaatctggatataggtagctacagcctgaaatatggaaagccagagcatgtgtatacctgctcctgctcccactggttgagaattgattcctttttcatctgatatgggcaagcattggatctgagtgggacacatcctctccagtgcacccctgccttttccgctgctctgaacttcacacaacgtcggaaagattcaaaacaatgtagaaaatctaagtataaatacaaaaaggaaacaagaagtttttctatcaaagctgtgaactatatgatatgagtaagctcaataaacactgtgcagaagttgggaggggaaaaagagaattgctgccaaagcactaacccctgtggctggctatgcttgcccacccaggaagctcccatgtcatgggggtcaggggaacctagaacagaaagctgaaaggctcagggatcccttttgagaagggatgctggctatacagcacgagttagaacttgcacagaaccgtccactactgctgacactggaatcacaggtgggctgacaagatgtgatgcaagcaccagacatatttgctacaaacctcaaagtggagcagagcagcggcagtgtcagtcttcttggtgtcaatagaatacctgtttatttgttgaattctccctatatgaataataataatacaagaattcaaagcaggataggctttgtgtcattggaggagtatggagaaccatcagtgcagtaagtgtcgtgggaggtttctagacagtttttaaaagtcgatattgagtcaaccatcaaatgtgaacaattctgatatgccagagcatttgtattcttaactcatggggttattacaaagatcaaatgaaataatcattataaagcactttgtgcagtgcctggcacaaagcacgcactcaatacatgttaatgtttatacaattattattattgattgtcagaattatcagccccacatcagcaaagaatagtaggtggtctgtcagcaggaacatggaaacattctcattacatagaagtcagtgttgcagggacagtcattaaaacaggatctaattttagtcttctgagggaaaatgctaggttctccggaaatgttgaatccttcctcgagcatgtagtttaatttttcaaaattatattgcatatcctgtaaaatgaaaatgaaattgtactgctgttcattaaaggcccccaaaaatcttaggcactatacaatataaatgaaaaaaaaggcgttatttttccatagggcataattagaaataaagaagcaaggtcactcacaaatttccgagctataaaggaggaaaggaacaagattttcccccggttattttatagctgccaggttgaactcatacttatccaatgagccccagaatggaataccgttctacaccaactgtactgatgatagtgattcagggagtaaatgataagattccatccttctaaagtgcttttgggattggattctagtaagtttcattttgctattggccaatcacaaaagagactacaatagagaaaagtgaagacatcatgctgaagacagactgctgcatagaaaaggaagagggaccccctaatttagagatatggatggagaaaaaaaggcacttatgctgtagcataagggaaacattaaataaagctataatagaggagaaaatgtctttgaatagaagaaaaaaatcagacagacagaaatagactaaaatgctaaaaaaaaagatacaaaaggacattgaaggggacatacagtgattattacacaaattaaatgcacacagttaaaagggaggtgaaaagcttctaaaaagaatgagtgtgtagtgaacttaattttatcatctttactaagacaaagttaaagtccctaaaatattttaagacacttaaaaaaaaaagtcttaaaattttgagagcctttcagctctgtcaactctagactttccctcctacttaagttttttttcttttttttcttttatcttttttatttatttatttttttttttatgttttttttttttttttttttttttttgagagagagagagagtggatcagccttaataagagaatggtcttctgccaggtggtattctcctaatccctttccagtgagatccacaagggttcaaaaccactttctggggtcttagaggcaccacttatctctcttcctctgctcatatctttctgctccagtgcccgcatagtttgtgttatcagtggtgcgtagcctgagacatccacgacctatgccagctctcgaagtaatgtgattggcatccaaagaaacacaagaagcccatgatttcgtccctttgcaatttaaaatcatatttaaaatgccttttggtcatacaaatttgaaaatgatcttgtaaatcacttccgggaatctatggtcaaaactcagcttagagttctctacttcttaacagagtgcctgccggtaactagtgactgtcaatgagtttgaaaacataaattgatgtgcaaatgctagataatagcaacatcctgtgcaactgggcagcatttctgttgtttggcttttttattttcgtggactctcccaatctgagagaaaatagatttgagttcctttttaatcggtttagacccagacaaggatttaattggtttagaccccattcacctacgtgtgtcactctgtctccaacataacagaggagatgaccaagacaacatgctctccagccaggaggtggggaatactttggtgtcatagcagacaattattgatggaaaactcatgttagaaaatgtaaggtaccttcttctagacggagtaaaaggggcagctgcccagactttcattttaaatagggagcccatgatacaaatcttttaatacaattttaaaaagaagagacatagggggtatctcttaggacctgtcaacaaccaaccctctatcaaatggccaaatcacaggtggtctgcagcttagccaaaatgtccaagtacctttttgtaacacagaatctcctttgaagatccagctttcattaatgatccccagcagctctggtcaatgtgtcttttcacaaatgaagctttttaaaagctttcagtggacaaatgtggctttgagttttcaactaaatctttctgtttaaaaggagtgctgaaatgggcatactttataatcttaaatgctgcacacaaaatactgaaatattattgaccctgagaggttggttcaaatcaaatagcatactcacgtaaacgttctcttttcctaatattagcaacagggaatgtgaaatagagaggggcgggatatgctggataggggtgcaccaaaattttcaaaaagcctcgaaactagtgtatattgataaccttgtggcatctaatatctagtattctttttttttttttttttttgagatggggtctcgctctgtcgcccaggctggagtgcagtggtgtgatctcggctcactgcaacctccacctcccgggttcaagtgattctcctgcctcagcctcctgagtagctgggattacaggcgcccgccaccacgcctggctaattttttgtatttttagtacagacggggtttcaccgttagccaggatggcctcgatctcctaatctcgtgatctgcccgcctcggcctcccaaagtgctgggattacatgcgtgagccaccgcacccagcctagtattctatgtctattatttcttcataatgagactgggggaaatctttggagaattaatgccgcagttggtaaaatcattctataataatgggtaccattctgctctgtcccacatttttatgaagtctctttaaatttaaaaaggcaatgtgctttgtggttcttgagcaacttaaatacgttgctctgaatagttattgtgatgaggtaatttgtaacaacttttaggatcaatgctaattttcttaaatgtttctgtagtttcccctttattataaagtatattaggctggactcttggctgtaagtgacagaaaactcaactcagattagttaagaaacaaaagggtgttggtgacagtggtggctttcagactattgctgcaggcccacctgccatcctcttaacaccctcaacataccctgcagaaaagagagagctactctgacccgagagcttaaagactggtcaagtatgggcttgactctttatggcccaaattgggtcacatgcccacctaggctaggggaatggaatcgtggaattgattgattgattattgttgcaggttgagtcctccaagaagcagatgccagggcagatttattgcagaataacacctgtgaagaaataggggtggaagcagaattgaacaagggaagccatcagatcacaatgcagatcttctagactctgtgtcagcacaacaaggaatgccagagcaaagactgccaattagaggaatactgaattgggcagatctgacaatagtctgtatataactcgggactgttaacttctccttcctcaaccagttatagacatagaataggactctcttatctcaaacatcaatatctgtgtatatgaagtagagggtgaaagtttactgtacactagtggttctcaaccaagagcaagtctgtcccccaggggacatggcaatttctggagacattttcagttgtcccaactggtgaggaggtgctactggcatctagtgggtagaagttgtggatgctgctaggcattctctataattcgtgggatagatagcacaacaaaaaattgcccaggccaaaatgtcaataatgctgaagttgagaaaccttgctctataaagatacatgtcttggccgggcacggtggctcacgcctgtaatcccagtactttgggaggccgaggtgggcggatcacgagatcaggagatcaagaccatcctgggcaacatggtgaaactcatctctactaaaaatacaaaaattagccaggcgtggtggtgcatgcctgtagtcccagctactggggaggccgaggcaggagaatcgcttgaacccgggaagcggaagttgcagtgagccgagatggcgccactgcactccagcctggtgacagagcaagactctgtctcaaaaaaaaaaaaaaaaaaaaaaaaaaagatacatgtcttatgtgtactgaaagaggccacggaaaccttttgttgatacattcttgatagtttttgttcttatatgtagttatgaatacttgagattccatccaatttatttaacttttgaccagaaagggtagattgaattggtgaaacatctatatcctgaatatttaaaagattctgttttttaaaacaaatattaacttgaattaacgtaaatattcttagtagttaaagtccttaaagaccttagtttggtgaacagataagaatcatctgtgttcagcatatgcattgccttatgaagatggtaagtcaaaagtatgagtttatttctgatatttaaatatccctgaggtatagatttgtttactctggaagtttactctgttgtttgtttgtttgtttttgtttttgttttttgagacggtgtctcactctgtcacccaggctggagtgcagtggcacgatctcggctcactgcaagctccgcctccggggttcacgccattctcctgcctcaacctcccgagcagctgggactacaggtgcccgccaccatgcccggctaatttaatttttttgtgtttttactagagacggggtttcaccgtgttagccaggatggtctcgatctcctgacctcgtgatccaccagcctcggcctcccgaagtgctgggattacaggcctgagccaccgcacccggccttactctgttgttttatttcttcattatatattacaaagttgaatgttagggccaggttagatcggaaaacaagttaagtattccttatccaaaatgcttgggaccagaagtgttttggattttttatttttgtggattttggaatatttgcatattcctcatgagatatcttgggatgggacccaagcctaaacatgaaattcatttatatttcgtatataccttatacacataccctgaaggaaattttatacaatattttaaatacttttgtgcgtgaaacacaaaagttttgactgtgacctgtcacatgaggtcaggtgtgaaattttccacttgtgacgtcatgtcagtactcaaaaagtttcaaaatttggagcatttccgattactttggaaaagtctagaaaaagtttgatatcagtgcactgaaatcattttcaagtaggaacaatagcgatactagccctttactcatgcaaaattcacagtttttatctaaacaacacaaaatcattcaatgcttttatatttaatcatctatattcacctaaccataaaaaatcaatttcaatacagtaaggaaaagacaagaaaacgaatcattctaatcactgtattttgaaagttctttgcaaacaaccgtgaaatggttaaaagataggaggatggagaccagcctggccaacagggtgaaaccccatctcttctaaaaaatacaaaaattagccgggtgggttggcgcatgcctgtaatcccgggtactcgggaggctgaggcaggagaattgcttgaacctgggaggcaggggttgcaatgagctgagatcatgccactgcactccagactgggcaacagagcaggacgtctcaaaaaaaaaaaaaaaaaaaagatggtaagagaatgatgacttgttgcttactaaaataaaggaaagattgacactataagtgatactgtttgaaatctcaggaatctctgaatcattaagattatatcacaaatggcatgcaaaatacctgttcaaaaaatactcctcatggacatgagatgctaagctgctgatactgagtctgacctaggacaatgatgttctgtgtcacctcttttctgatgcctcccagattgctcctggcctcactgctgtctcacttccaaaaatacatattgcccttattggtcataacacagagactatcagttcaaaagtctctaattcgtctcagctgcagtcatctcccagcaagacacaaggttcttgagaaaagaaatttttcatgtcccatctttgccatccaccacacgatgaacatacagtacagtgtacatagcagcccttgaaaatgctggtggaatcattgattcttgaacccaactgtcatactttccagatttaagtcctggtaaatgattaaaatcgtatgggttaccctcaacaaaccagctcaagtatttactataaaaaagggaagctagatatggaacttcccctaaagatgggtctgtcaaactcaccccattgtattctgctctgacaccatgttttttgtttgtgttatttttttttaagagacagggtctcactatgttgcccaggctggtcttgaactcctgggttcaagtgatcctcccacttcagcctcccaggtcactgtgagagattacaggcttgcaccaccatgcccagccccaccttttaatacaaataagtaacagttaccatttactcagtgctcaccttataacagatgctgttaaacgctttacacgccttagctcatttttagttaaatacattgtttttgccccagctatggtagggatcttgctaacaatgagaatgaatgataagaggggctttaaggagaattcactgccacacctttcataattttcccatcattcctccagtctttgttcaaccgtccatgatttactgatttgctattacatcaaactatgctgcaacaaaccagtggttccttctgatttttatccatctcctcctcacctagggtgagagtctgaggcttccttgagtctactttctgatattgttacatttaacacagaacatctcttgttttcgtttctggcagcttatcctctcttcgctttctccatgctttcattcatcctaaaacaccattctgacaatgatatttaggttggtacataagtaattgtggttttaccattaccttcaatggcaaaaactgcgatcacatttgcaccaacgtaatatttttcttacttaaaaaattaatgtagagtatggaaatacttgccatcagggaatggggaagaaaatggctagagagacatggtgaaagagagacttgatttttaaataactttttttgtttttcttgaattttattatcatgtgaatgcatttgaaagaaatacaattttaaaataattattaaaaaaatatttgaatgccttcccatgaacaactaaatgaagtctctattcttaaacctgacagtcaagtacagctctggtttgactccaagctacatttctagccttgtattattcaactctttttctgtttatccttcatatccgggcctttactagtgccaaaaaaaaaaaaattgctcattctactcttgtcacccagagtgtttcttctgtttttgcccatcaaaagcttacccaattgtgaaggcccagtttcaaagcaacctccttcattaatttcatccagatactctgtaacccccatagctgtttaggcttgttctagcaatttgcagttatcagaaaaatgagtacataccgagtgccagaaagtggtctctccaactgtgcacattacaacatctcattctctgtgcctccatttcctcatctgtaaaatggtcactatggtgtactttcctcatagtgatgttcattctttcaagtagttagttaggtacctactatgagacaggcactgacctgggtcctgggggtacagtaatgaataaaatagattgagtcctgccctcatcaaatttaccttctgataagaaagacataaatgaaatatacctataatgctcttgaaatagcacttgggatatagtaaatgctctataaatgtttgctattattactgtcattgttggtagtgttgttatgtggtatttctattaacacataaagaaactaaggttcacaggctgttagataagatgctggttaaatagctagtaagggactccaactcaggtcttcctgagtcataaaattcgtggcatttccactacactgatggatgtataccaggctgtacatcagaactatctgtggagacttaaagaaagtaaagattctcaagcctcagcctcaaattaactaaatcagaaattatttagacgagctaagaatctgtatttttttgaaaagttctcaaatagttgtgatacactgtcaaattggggaatgactgcactacattaaaatctttcccataatactttattatgcttatttgtaaatatcaaatctacaaattcactaaagaccatccccttgttttcttatttatttttattttttctgcttcctctcctagcaaagtgccttataaacactcaataagtatttgagtaattaatggcttaattatttaaagttgcacttaaaatgcaaatactcacagctgtggtactggaagcctgttatgaacaatcatttatcttcctagggttatttactaatcagctaaggacaagcagttgggaaagaaaggctgactatttgggaacagaactgagaaggccctcaaaccaaatgttagccacgttattgaacagcctagggccccgccttaactttacctacacttcgttgacaatttcaggtaaaatgcagaaaatatacgctaacaatcaggagattcctccctcacaccattgtagtttcatttcttttaagccgacacatgtctctcttatggaaaatatgggaacaacctgttttaaagaaagaaaaagaatcctttattcttgtcacaccacaaacatggagttcactgctatacgttaagattataaagcaaaatcccaaaaacgcagtgactgattattcacagtagacatatgaagtcaggaagcttattttttctctctttgctaaggcacaaagcctggggctatatgcatttttattacactgtactgtgttgatttcacttgaggattaaaaagagagttgaggcacagtgcacgtatcttgatggattttaggatttcttgctttcgtgaaagaaagaagcttataaagtacctcagattatcgcccagggaagtgtacctacttccatgatgacctagaaattcaatcttttgtttctcctataaaagatcacattgtactttggatgttttccctgtagttttctgcactatgtaaagccacatttggaaaaacaaaatagttttagtttagagttgaagtgaaaatatctgaaatagttcaggaaagtcttatgagcatttggggagcttacaaacagccttgggggtggggtgagggggaatgagggaagagggaggcagggggagagaagaggagggctaggtcagaagtgtgcaaagaagacagagggagagagaccgtagagactgtgagtccatggcagagttttaattctggttctcacacatctacacagagaaacaatggaagcacattgctccatcccctgtcctttactaagaagcgtgaagtaaataacttgtggcttatgatatgcgaagaagagagaagacagaatgttgtaggatttggaagtacagtagatgagatcttccggtttattgatttgtaaagaacggcttgatactggtttgtcagttctgcatcagtgagagaaaagaaaggcgcttttcagtcacttgccagaggaggagagccgggaagtggaaacagggtcttctggcggacaagcttccttgagtggtggtcaaattgactgtgaagggagtcaaggtcaggaagctttggaaatgctgcaaggatggtacgggatttaaggagggttgatttcctcggttaagggttgttgcagacttcagcaaattcccccttccagcctttattaaagaagtgtttagtagaacaaactgaaaatctacaagtatattgttacccaaaatataaaagcttctgccactgagatgaaaatgtttgatttccagtgctttatctttttgcatttatctacctgtttcagtcattcgttaatatgaatttcctaatatatgccgtcttttttttttttttcggacaataccagttctatggtatctcactgatgattatttcaaattgccacttttgttccttggaaatactcctgtgttcaaataccaggaggcataattatgtaattaccatgtgaacattatgctacttatgggccaaaatgcccctagaaaggaatgctccaatggcctcagaaaatttctgtgagaacgatatcttccaaatgtggtataaataaagctcaagaataaatagctaaggctggaatgtaaatgatttaatgtaatgatgttgtaaggtgagagccacttgactttagttcctgttgcaaatcatgagatacattaggaaaacttttaaaagggaacctattttttaagataaaatctgtatcaagttacatcaccttccaggcaaagtaattcaactttcctcttttctctctgagaccaaaaaaaaaaaaaaaaaaaaaggcagaagaaatgcttcctatgatctcttctcttcctgtcacaattttcataagtctgtagatgtaattaaaactaaagattttgacaaatgaaacaggataggaggttgattgctgcttttctaaattaaaatgaatgatacccttaaggtacttgggtctatgaagtcaatttaatgttgatataacctgactccattatcacagaatgaggcagttgcataagcaagaaaaccaataaacaaacatccaaagtgcattttagaaatcggtgaggtgaaagattaaaggcttaacaacggacaaagagcttgctgttttgttctctcttgccttccagtttgatggcagagttcatcagaattagaggaagaatgttcttggagaagcgttgggctggcactaggctaggagtcctattcatatcctgcctcgcttgtcttgcaagcatgcacagccccttcatttgaggcactgtttgcctcagcagagtctgtgtactcttctggtaggttgtatagaacataataaagggggagggctggaggagaaaggacagaaaaaggagggaataaaaaaaggagtcagattaagaaagaagtcagcacagaaatataaaatggaaggaaaaaaagctgtgatgcaggaaccttaaaaggtagattaaggatggtctcagatggcacggcattagtatcaatgccataagtcacacaaaatctattaagaattatgctcctactcagagtgagtgccatgttagcactagttgtttcccgtgatctatcctgaagtcaaacgcaagaaacactgtttaactcctaagtgccctaatgtcaggaaaacacagaaataaactcaaaggaaagacaattcagttaatctttgcattcaacaagcccaggttgttttgccgcagagctatacctatcacaaaacttcattccagaagatggccggtagaggtggctcatgcctgtaatcccagcactctgggaggcccaggagagtttgaaatcaagaccagaacttatctcagactttttttttttttattattttttcagttacaactcaaaagaatcagaattagaataataatggattttaactgaaagggattaccattagttaaaaggattttaactgaaactgtaatcagtctcaggagcgtttcccggataatgtttgggcacgtatttatgagtgttacttgtgaggatttgggagtaagaatgaacgaggaagttcctcccccaacacagacacatgcacacagaaactgtacaaactgaaaaacttcaggacaaaaactcgtgaatagactggagagtcatttgtgtgcatatgtgtggtttatttactagcatcacagcacaagagtttctgtcttttgcttttgtttttgttttaataggctcatttgtgtaagtgtcatgtctgtttcttgcattcccatggatatttatctagggtctagacaaactgagaaccagaaaatcaaaacatacgttcctagttacatattttctctagactggagtaaacatgatttatgtatgtagtaatcagtaagatgtagcttggacactaggaagaaaccacattgcctagcagtgtatttccacatggggaggtaatgcctgtctctcctaaacttctagtgaagataaaactcaaagtagagtaattaacagaaaggtcaaaagacaaagtggaagcccttgagaatctaaaacaaagttaaagaaccaacatttacatttagataaatttatttgaaataatttctaagagccatgatgttgttatcggtcctttttctttctttcttttattcttttggcttatttaaaagcaatgttgaagaaaaaatgaaataaagcttatctttcacaatacacagaggaatggactgagctttgggaaacagtcacagcttggaattaagagtgtgtgtcgtatcgtaatttagttggatgatttggtgctcattcattatacccagaattacgctttcaagtctaccgtattcatacttatctcagtgcctgacaaataagaggaactcaaaaagcctttcattcattcatccattcagtatttcttgatcatcttctatgtactaggcattgtgataaattcttaacaagacagataagatctctgtctttgtggacaataaacttacattctagtcaatatcttttgaatgaatgtagtgatatttcttactgaagctaagaaaggaaggtctctgcaaacagtatactgtctacagaactcatctgaaatgagaagaccaaggagaataatatatagccctcataactctcaaatcttaaatatgattatttaaaaactagagtaaaacaaatgtggaggagatttggacttcagggttgttttataaattgccgttttacatttttaaatctagtattataggcaaaattgaatctaaatggttttcttcttttcttttttttactttcatcatcaaaaatggaagaaaggaagaaaaggaggaaggaagaaaagaaggaaaggaagaagggagggagggaagtttttcaaaagcttgtgtcagggatcttgaaaaagaaatgattcattcaaaatatagttgttaatagtaaagatccgtgaataaacagtacattaattcattcaactaatattaatttagcacctattatatgccaggtactgtgctactcactgaggatttagcagggaaagatgtgtccctgtcctcatggaacatataaaaaaggacctttttttcctgagatgcttttactgaagaattgctgcaacctagattatgagttctcatggaccagatggcagttttctgcccatctgggatagttctgaagaatagaccctcgtgtatcaatcaaggtttcttccagttctaagctttcgtgatctatgatctaatagttgaaacaggatgtatgcttccaaaaagatgttatatttgtattacttttataaaaggaaacagagacatgccctattaattcagaagagattgggttcctcctggctgtttaaatcattctatttaaactcctttatctcttctttcttggctcaccttccaaagctcactcttaccccttttagtctcacttccctttcctttctttaattgctgagacaaattgttcatctctaactggctatacatgacatctccagttaaatgtttcactgttaggacaaattcattatgttccaaatgaattcatacatacatatgctatttcttccttttctgattttcatattgccaccagcaatatcttcattctcccagtcttccttactcgaaatccaagagtttatttgcttcttcagatattaatctccaacaccaaattggatagttcttcctcctttcaaaataccttctcatatgtaccttcttttacattgaatacaatacagccttaattctaatgcatatcaacccaagtctagtaagttacaacagcctctttctgatctcagtctcaggtgccctttcgaatctgttttacactatactgatcttcccaaaccctaactttcctctaaaatagtgagtcatgtcacagaaattttcagtggttctctttgcctgcagggtaaatcttgagcctcagagtctgggacgccttgctttgcatcatcggctttcaacatgactaactaattgtatctcactgtcgtcctcaacaccactgttctgcagccccaagcctttcttcagcttgtcactacttcttacctccaaacctttacacttgcagagatcagggactatagcatttgttttttgcctatctctttcaatattaacaaatacttataaaatgaataaaccaccaaggaaagaactgattgtgccagaacataagacacaggtatatcatttctggcttttgcttcctgttttgtatataccacggtatattgatttaacatacagccagttagaaagatctaatgcatggaggctctcgtttaatagattatcaaatttcatttccttgcataattgctcaaagaataaagtgctttgttcctaagtcccaagctaaagctttcgaggactttggttgctttcaagtttttctcattcataaatttgtttctttatttagccagttgtgcattcaatccacacaaaacctttctccagtgataatttgtggaaagaaatattttatgcttaattcttctcgctgtcataccttctcttaagtttgagttatgaagatggaaattcactttgatctcattttaaaatcttgacaatattgaatgtacactggaaactaccactggagcgctccttgtataagaaggcaaaattcttcagagagaagattgggagtctagaatgaactttgatgctgcatcggctcagtccctatgaaactaacattcttactagagaaagtggcctatggcacagtcataatcctttaccatctacatcttccccttgggatttctttctcagtatgtgcaaagatttctgatcagtgtccactcccatatggcatcttcatcttctcctctctacccccaaacactcacatttatctctagattgatttattcatgaaatgacccattctaaatttagaaataatgacatatgcccaacatttatttgcacgcgttttcccacaacctttctctataatcttatggtatcacattcttcaagaccaggaattgaccttgcattgggccataaaatacgttgaacaactgcagtttcatcgatatgcacactagaattggtctgcattcaataaactgattaaagaaattaaaaagccaattacttattaaatatttataaaatactttttttcaactttaatcttcaggatagcagttaagagcaagacccagactgaatgagtttgaatcctagctctgccaatttactaactactgaagcttaggcaagttttttttttttaacctctcatgcctcagtttttatgtcaatgaagtcggggggaataatattaactcctattgcagagttactgtgaagatgaaataacataattcatattgtcatgccacatattgcttaataaacattagccatttttgtattgtatgtggtgccctgcacattatagtctattgctctccttttttgctttttttttttttttttttgagatggagtcttgttctgttacctaggctggagtgtagtgacacgatctcggcgcactgcaacctccacctctcagattcaagtgattctcctgtctcagcttcccgagtagctgggattacagatgcccaccaccacaccaagctaatttttgtatttttagtagagactgcgtttcatcatgttggccagaccggtctcgaactcctgacctcaagtgatccgcctgcctcggcctcccaaagtgctgggattacaggtgtgagtcaccatgcctggcctattcctctccttttattaaccataatagtagcaagaacagtagctggtaacatttattgagcaattaccacgtgacagaaactaggctaaatgctttacattgtatcatcttatttaattcccacaaaaccctataagttatattattttccacattttactgataaggaaagttaagaataatttacccagggacattgattagtcaaggttctccagagaaatagaagcaacaatatacatatgtatgtatgtatgtatatgtgtgtgtgtgtgtgtgtgtatatatgtatgtctatgtgtgtgtgaatatataaaattaagtattatctcatgcagttggagactaagaagtcccatgacctgctatctgcaagctagagagccaggaaaattggtagtgtgatttcagtcccagtctgaaggcctgagaaccaggggagttgatgatgtaaatcccagtgcaagtgcaggagaagactgacatcccagctcaagcaggcctgcagggaaaaaaggaacatgcctttttgttctgtttaggacctcaactgacaggatgatgcccgcccacattggggagggcaatctactgaatccactgaaccaaatgctaatcttgtctgcaaaacaccctcacagacacacccagaaatagtggtttacctgggcaccccatagtccagtcaacttgacacatagaattaaccattacagacctgcagtcagtgcactcagtgtcagtaggcatacttgtttgttccgcatcgcttctcttctcttctctctctctctctctctctctctctcacacacacacacacacacacacacacacacacacacacacgtaccacatttactcatttactcatccatttgtttggtcaactagtcattaaacaaatatttgctaccatatactatgtgcctcctgcagaaagggttggagacattcgaagagaaaggtaaacaaaaaatggtccctgctatcaagaagtttccaatctattgcaagacacactcatgtccatataactaaaatgaattatatgatagaagtgcttcaggtataaaccatatactgttagaatgctgaggaagccattaattctaacctgggagatgaggaagtaaacatataaacactaacagcattgatctgggagagaagtggggtaagagcattgccgagagaaggagcagcatgaagaagccacgcacaagagttatattggatggaatagtgcaggacaggcaggtagttttggtgggcttagcaggtagagtttgggagtgcagggtcataaggttgggaaggtaggtttgatatgtccctcatgcttttgtgtatataaaataaagtaaatcctgcattgtaggggaaccccacttggttatccacgtatttgggccaagcaaaaatgggcaagtctagggagagagtgaaaaaatgagattgttctggatatacactaggcacttaattgatattggaaggccagagttggtttgagaccaggctacctgagccacttttctgatgagattaacatcgatttttacctctcgggaattctgcacaccacgggaactaccccctgagttctgattgctctgtgcaagctctgatcaacccctagtttagcatggactgttcacaactaaatcaaaatccagagttagagagctaggatgcctggagccaccacttatattggattggcaaaatgccaaataagtaagtatagcatgtcacccgtaaaattattcctttcttccccaccaagaatagaactcactaagttgacagcacactgtgtcaatatattatagaaaaacctaataggaagaaaagaatggcagttttcactgcatgccccctaaaggtatatttcttaataatttccaagtccactgaaaactgaattccgaaaattagttttatcttactacccaccctattttatcccaaatttaagccttgcctgtacttctttgatacttaatatttttttctttgaggtggagtttcactctgtcacccaggctggagtacagtggcgtgatctctgctcactgcagcctccctcctgcctcagcctccctaggagctgggactacaggcatgcgccaccacacctgactaatttttgtatttctagtagagacgggttttcaccatgttggccaggctggcctcgaacttatgacctcaagtgatccagccaacttggcctcccaaagtgctgggattacaggcatgagtcactgtgcccagcccataattaaatattaatcaaccactggttaattaataattatcaataattaaatatcactcaatgatttattatctattaatcaatattgcttctttaaaaatttgtcaaaaacaatagcctaagacttaaagacaagacatgtcatttctgagattctgtagtcacctataccaaatgtcaccctccctaatgtttttgtgaaagtaaagatttgtatttttttatggtactaattgaagcagtagttcatttgtggctgccaatgagttgactgtaaaaaaaaaccaaaatctcattttaacattgtcgagagaggaaatcctttgtgtttggccttggattgataaaaacgagtctggaatactatatacggtaagtgaatattaaaactagagttatgaaatgttgctttagtgttctcagtcttggagactcaaagtatcttatcagaaaggatacattgttttaattgttcctcattatatagaatgagagaacatcatttctctccttttcctcccaggtggccgtcgaggaccgagtcaggcagctgcatgaagcccacagggactttggtccagcatctcagcactttctttccagtaagtcattttcagcttttatcacttaactttattgcatcttgattaataagaataacagttgaaaaaacaaaagaattaagagttgaattatagtaatcttttatcagatgcagtagaagcataaatcatcctgaaatataacttggttgataagttgagaaggttaggaagaggaaggccaattggatcattttgtccagtcttcagctaatgcataattgtttcctgcactatattctcaaatgttaaccatattaatatttttgagtctttttgaaaaatgtggaacactttgctcaggagccatgctagtattctctgtatcattattccaatgttagtatatgggctgctgaagcaaaaacatacttttgagtttttaatttctgcctatcagttcagttcataaagctaataattatgatatcatgtaattataatatgatcatccaatatatgttactgtgactctataattctttaaataattcattaaatgatccctgccttatgaaatgagtgacaattctcaaaagaaggcatacaaatggccaacaggtatatgaaaaaatgctcaacatcactaatcaccagggaaatgcaaatcaagaccacatgatatatcgtcttaccccaattagaatggctattattcaaaagacaaaaaataacagattctggtgagaatgtgaagaaagggaactcttttacagtgttgatgaaaatgtaacagtaaattagtaacagtatgaagattctcaacaaactgtaaatagaactaccttaccatctggcaatcccactactggttatccatcccaaagctaagaaatcagtatatcaaaagggtacctgcacttgcatgcttatcacagcactgtttaaaacagcaaagatgtgaaatcaacctaagtgtatatcaacagatgaatggataaagaatatgtggtatctgtacacaatgaaacactgcaagaatgaaaccatgtcattcacagcaacatggatggaactggaggtcattatgttaagtgaaataaccctggcacagaaagacaaaaatcgcatgttcttactcttgtgggagctaaaaaaattgataataaacatagaatagaatgatagatactagtggctgggaaaggtgtgtgggtagagggggagataaagagagggtggttaatgggtacaaacatccagttagatagaaggactacgttatatcatttgacagcagaatagagtgactgtagttaacaacgatgtgttgtatatttcaaagtaccaagaagaaagggcttgaattgttcccaatacatagacaaatgacaaatactcaaagtaatggatgcctcaaataccctgacttgatcattatgcattctatgccagtaaaatatcacattacctcataaatatgtaaaatattatatatcaataataaataaatactatgcctccaagttgaaacctcagcctatgggcatttcctttccctaactgtttgcatccttcctttttttttttttttttttttttttttttttttttgagagggagcctcattctgtcacccaggctgtgagtgcagtggcgtgatcttggctcactgcaacctccgcctcccgggttcaaactattctcctgcctcagcctcccgagtagctgggactacaggtgtacaccaccaggcccagataatttttgtatttttttagtagagacgaggcttcaccacattggtcaggctggtctcgagctcctgacctcaagtgatccactcgccttggcctcccaaagtgctaggattacattcgtgagccttgtattctccttttgttcttgacctctagccattctttttatttactggttttgctattttattaattatgtttttataattaatactaagagaaataaccttggttaactgaaagtttaagtattagaaaatcctatttatacaatattgcatattaaattggcaagcacctgttttcctctgattaatgttaatttataccactttttatttgattataaaagtatatgtgttgagttttttggtatttaaaaagccatactttaccacatggagttaacatctgttagcattctgatgtatttccttgtggtcatatatgagtatatatgagggtttatccatcattttaacgcaattactttgtgcctagaaatgttacagattttaactagtttaatccttatagcaatcccttcaatcccttaaggtaggtaccattattatacccatttcaatgatgaagaaactgaggcacacattcatacagctagtagatgagggagccaggattgaaactcaagaagttggctccagagtctgtgtttttaagcatcgcactgtaattttacttaatttatatattttatagagaggaagtaattctgtatgatctccattcttctgccatattctttcattgccattttctgatcatttcctttcttttccattctccacgggttaataaaaagatccacgctcacaaatactttaaagtatttgagtagatgttgtcatgtgtgtctccagttggctgttgtctttttgaacaaaatttcctggaaggtgttggtcctgtgtttttgtcatacatcgataatagattaagaagaagtatcttattttctggactggctctaactttattatccgcatgtggtctagttatttggacacagtttcacaatgctttggagttgccaagaaaaagggataagttaaagcagtttatctaaatgagtgggatcgtggcttttaggaacggctctagaaaaatgataaaggctacagatttcgtcttctgcatctttccaaatctctggtctacttaacttgccttggtgacagccattctattcgatttaattgagattaaatgtgataacatactcctaagcgactcataaaccataaataaaaaatagtactattatgaatattaattactcctcagacaccaggtatattcattcatattttcttctccctgactccccctctgaattcccatgtcttacccattaaaacctattttcagaaaatgatatactcatttaacccaagtgataggtaaagtttaatgtgtacttctcctgggttatttgcattttattagtgtgaaaatccataagcctgaggtggtagaacatcggccataagctctgagctgtgaggaaggaactttgaggggccaaggggagcattctcacacctttcaaaccatatcacatcagtgcccacttccagaaaggtcaggcctgttagacacaggtattcataaagagactgatctacctgcctgaatggagccagccccggaagtcatcagtctcttggatgcccatgtggaatatcaatatacgcttaaaagctttgcttgcaggtataaagaaaataccaacttggtttaagggatatttaagaaataggacggtgagactaaggatggattgtttctttacattgtactttttaaaattacaaaggtactctatacacatcaagaaaaatttggaaagcccacagtacaaacaagaaaagaaaaagtatccataatcctatgactcagagataatcactatcagaaatttggtttatatactttctgtatttctcttgtggttgcgtgtgtgtgtgtgtgtgtgtatcaaggttctatcttttatttttttatttttttgttttttgagacagagtgcaatctcagctcactgcaacctcccccgtcctgggttctagcgattctcatgactcagcctcccgagtagctgggattacaggaatacgccaccacgcttggctaattttttgtatttttagtagagacggggtttcactatgttggccaggctggtctcgaacttgtggcctcaagtaatccacccactgaggcctcccaaagtgttgagattacaggcatgagccaccacgcccggcctctctcttttcttttaaaccatgcgcagataaaaacatgctacagttttatgagctgcttttttcccttaaaactatctttccaatattttcgtgtgtttaaatattcttcttcagagtaatttttctaatgactggctaatactctcttctgtggctgtaccaaatttaccaacacaattctaaattgctcaatataaagattatttcacaatctttattatatcgagcattatggctaatatcctttttatacctttacaaatatctcagattctttctacaggataaatgcctaaaggtggaattgtcatgttaaagaatgtttacattcgtaagccttttcaagtgtattgccaaacttacctctagaaaattgcaccagaaattgggtgtgccatccaaaccgtatttgagctaggcatggtgtggctcatgcctataatcccaattctttgggaaactgaggcaggaggatcacttgagcccaagaggtcaaggctgcagtgatccataatccacccccccccgcactccaatctgtgtgacagagcaagaccctgaccctaaatttaaaaaaaaaaaaaaaatcaccatatttgaagcaggacatctctgaagtcacgtatttgctactataaaagcagcttccccccaccaatgaataaaaatatgttttaaatattcctctaaggtcatattaaatgaatttgaattgatacttttttttagacaggcctgagttgatacatgtttagtaatgtgctttcaggttactataaataataatagggtggctcctaaagcttagaaattacaaagaaaagaaaaataaggaggaactactaattgcacccgccagcgtaaacatgcttactgtctctgtttatcttattctctctctctctctgtctcgcacgtgtgtgcactctctctctctctctctctcacacacacacacacacacacacacacacacacacactcccctttggaaattatttggaaattacattaccagctgtctgttgtttatcagaagacagaggcagccttttactaaaaaaaagaattcactgtttcttcctggtggcccaatctctacatgttaaagaaattttttcttttatcttagatctaagagaaaatgagaagagaaaagcattgtgaaatatgacccttctccgctgatagacactaacttgtccttacttctagttttaatacactgctactcctaattgacttctacaacttaaaccaagaaaaaggagaaattctaatagtgtgacttcaaatatgtatataatttacaataaaattatcatttaaattatttaaattatatactaatttatagttatatatgtataattggtaggtatattgtcagtctcttcatatgtctgtgattaagaaagtactaaagtattcattggttggcatagtagtctgaaaattgtccttttcttttgaagagtttaaagatttgttgggcgtggtggctcacacctgtaatcccatcactttgggaggctgaggtgggcagatcacttgaggtcaggagttcaagaccagcctggccaacctggtgaaacccccatctgtactaaaaatacaaaaattagctgggcgtggtggcactcgcctgtaatcccagctgcttaggaggctgaggcaggagaatggcttgaaccctggaggtggaggttgcagtgagctgagatcatgccactgcagtccagcctgggtgatagagagagactctgtctcaaaaaaagaatttaaagatttttcctgaccattatttcaattctctggtcttctgttctaaattctacttttctcaccaagaaagatcactatatatttgggtaaagggagaaatcattctataacagtaaaaagaatccatggttttcttaatattttacaagttccagaggtcccttaaaagaatattttccaagccaggttctttaaaacattaatgttatattaggttttgataactgtcccttgaaaaaaatagtactgattaataagattggaaaaacactaggtttcaaagataagcaagtttatttcttgttagaattcttggaatttttattatacactgagactctaagaggataaggagtctatagttctccagttttaggtgactgtggaagcctttttcaggcacaccagttaatttcacactaaactttatgccatggatcacagtgaatctttgccttaatgtggtatttgccagatgctttaatgacaaaaaatttctgctaaaggttgtagaaacgtgatccaattaaaaagaaaatgagtatttatgaggcaaaagggtcaagtccctctctttactgaagttcccagccccactcccacccaggagccctcttgtgctgtggagtttcctaactggagataagcttagaaagtatctataccagtagtttccaaactctgaggtgtggctcattagcaaatcctaaaatcagtttaatgacttacaaccaacaatttttgactggtatggaatggaatggaatggaacagattagaaaatatcagagtgcattacctaagcaaggttaagtgttgttttggcggtggttaatttgttagatatgtgtgtacatgcgtgtgtgtgtgtgtgtgtgtgtgtgtgtgcgcgcgcgcacgcacgcgcgcacgccagatcacagtgtaaaacgtttttcttctgtgggttgcagtcgaaatagtttgagaaacattgaatcattcgagccctttccttattttacagataatgaaataggtgcagaacgatcaaatgacataaccaaggtcacaaagatagttataatactgggactggaacccagtttctggacatccaagccacacatcacactgccttacccgttaagaagaaatgcccaggccaataactgtctagtctatctgctattgccaacgattattctctcgtatattcctcttcgtttggccatcctaagttgatttacataacctaaatttttctctcaacacctctgggctaaaaactgccttatcaaaatggtatcgatagcggttaagagtaaaagctgtaaaatgaaactgactgggttcaaatattgactcagacactttatgcttttttctttctctttattcttcatctttaaaatagggataatagtaacatatttggtcaattgtaagacacacttttccacccacgtttcaacagttctgaaatcagaatgcaccatacgaccaatgggatattgaattcggtgaaatatggctgtattatttcatagggttacagtgaagatcaaacagttaatatttgtaaaacccttagagtagtgcctggaacatagtaagtgctattcaagtgtttgctattagctttagcattagtatcattattactatcagcttgatagtataacttaatgcatgcctgttagagtcaaactagtcatgaaagtttcattcattctcttgcatttaatggtcagtataagtagttcctctcctttctgaagatgatttccaaggatctaatctgaaagtccagtgttttgcacattagaacggctcaatagttgtttgtataactaacgagtgataaataatcaaaaagatagaccttaatctctaaaatgtcaggatagtattagtcttgttgacagttatattctacagtacctaatgtggtatgtggtacttggtagatgttcagtaaatatttacagaatgaattatgtcttatacccaaaagaagaagaggtaaattcactcttgacattgataatacacagaggcatgagatttagcatagtggctatcacatagtagacactcaataaataatgtgaccttttctgttgcttctcagcaaagactaatagcattcataactttatatggtcgtttttatcaaagtcgactgtaccatgtaatacattaagggaaaaggctgacttcaaaattacagcatgatcacaactatattacaaaataaaataaaaataacagaaatgtacacataaaggaaaaatggaaaataaaaagataccaaaagacaaacagttattgcatcatttctttctttttacttttacaaattttctggtaatagcatgtactacctttgtaatggaaaaaaaacaataaaggtaacattttatactccagcttttaaccagtgacctcttgcagtggcaatgggactctgaaagacaaatttcctttttactatttattctgaatttaaaagctgtttcattgagtgaccttctcagattatgagacactgtaaaaagaaataactgatccattatttcttgcaggctttacaatcttaactgccttaatcatatccctggttaagtctttttctctcttgtcaaagtgactcaagcttttacagtttctccttgatacatagggcctagcagtttgtttctatcttgagagttgccaagctttcatcctggacattccccactacacatacacacttaattttaaaaaataggggaaacctttaagcacatctaataattgctgacatttcacttaacagtgctccaacctatgctaccagtgtcctcaggggacagacaatttgaaatatgagtggggcaataatttaaagcttcagattggcttaaataagccatcatgaggccgggtgcggtggctcacgccagtaatcccagcactttgggaggccgaggcgggcagatcacctgaggtcaggagttcaagaccagcctgaccaacatggagaaaccctgtctctactaaaaatacaaaattagctgggcgtggtggcatgcatctgtaatcccagctactcgagaggctgaggcaggagaatcacttgaacccaggaggcagaggttgcagtgagccgagattgcgccattgcactccagcctgggcaacaagagtgaaactgcatctcaaaaaaataaaaacatcaaaataagccatcatgataaaagtcagaaagaattttgcaggtccaatgtgagatgatttgcaggctaaaattctctttcaagtaaaatctcagggtgaaatgatttgagccagtttcttcagcagtcacatgttgtcccaagtgttaggaatttgggacaaatgccatgtgacctaccagtgatgctgataatgcccctataaattcaaagacagcctttccaatgcccataaaaagcagctacagcagtaataattatattctcttcttaaaatgtgttgtcatggcccttttctcctttagctcaaatgtatactccccaataagctctcagatttatttgctttacagtatcattagcaaccagattttgcatcgttggccctatatatcccatcaatttgaacacatgaggaaacagaacgtttttgtttctgctatgggaatttctgtgctggggctggcttacaatggctcaagagagccaattgtaaaatatacaggaattgtgagctagttattaagcctacctttggtagcttgaaatcaggcatagtgggaagatttactccatggaaattggcaaatactacaaattggggcactttgttttttttttttttttttttttgtgcatagatggtttcccagaaatgactaatttatctatgttatttggatcactcaagtccctgtaggcaaagaatcttcataaacttagcaggaaggatgctcaggatccaaatatttatgtgcgttgcagagtgaccactcatcctggtttgtctgggactttcccggatttagcactggaattcccattttccaggaaatctctgtagtcccaggcaaaccaagatagttgctcaccctagccttaggtaaaatccctagaagtagagccctatttagatagatggggcttcttgtagaagtaatttgttcaggtgaaagggagtgagggaagcaggataaagtaagaaggatgctggtcaaggagttaagtgggaaggaagagactcacttcagcttgatcccacagggagctctggagaacaaattgtccctactttgagataaggggcctgggctttttgtttgtttgttttgagatggagtcttgttctgtcacccaaactggagtgcaatggcgtgatcttggctcactgcaacctccgcctcccaggttcaagctattctcctgcctcagcctcccgagtagctgggactaccgcgcctggatttttttttttttttttttttttgtatttttactagagacggggtttcactaggttggccaggctggtctcgaactcctgatctcctgatccgcctgcctcggtctccaaaagtgctgggattacaggcgtgagccaccgcgcccagccagggctgggcttttattttcccgtgtgaattagtcattggctgtggatttctggggagtaggagatagcaaagcagttcccatttggccaagggaggatttctggtgaaaggaccaatgaggccttagcaaccaacactcacaacaactgcggctgggtgaaccagctcagtaaaagggatctgagtggaacaacaatagtattaacctctcctagactttatgaagctgctatcataccccatgcataatctggctttagagctgaatgggcgcatttagctggatcactaaccaccactccttcgtcacggacttacatggaaattagcccggtggcatggaagagatgagacaaatgtctgtttctttcttatttcatcttcctcattgtgacagattcttctgggcctcatgaggagctagggccaagagaccagcaccagagttctgaatcagttttataacatgggcactattttggtggaatgctggctctgaagggtgtatttttacactacccagaaaatgaaggcatttgtgaatttggcctggggtagcattttgtcatctgtccaaaatacaaagctttgcacaacagaaatagtgggatcacatccctgtgggcaagaatcattactttcgtttttccatttggatgttttccattttcagaacacaaccagtttgggattacaaagtactttctggtgagaactttgaagtgaggacaaaaggcattttgttctttagtagacttacataaactgttcctggtttaaaaaccattctagatttttaaatagactttcagatatctgcagtaaaaatcatcttgatttcaggcgactgcaggtactgctctgttatgtgctatgtctccttaaggctgtaagggacagggataggcttaggtgataaggaacattttcaggatacagagaggcatgaagaataacatgggccgggcgcggtggctcacacctataatcccagcactttgggaggctgaggcgggcggatcacgaggtcaggagttggagaccaacctggccaacatggtgaaaccctgtctctactaaagacacaaaaaattagccaggcatggtggcgcacacctgtaatcccagctactcaggaggctgaggcaggagaatcgcttgaacccaggagacggaggttgcagtgagccaagatcacaccattgcacaccagcctaggcaacagggcgagactccatctcaaaaaaaaaaaaaaagaaagaaagaaaagaataacatggaacaacagacaccacgaaacatgtttgcttctttctgtatatgcatttgctgccatagacttcagactattacagtatcatatcttctctcttctctccacctaacaccttctacttatagtttctactttcttatgacttccattttcttcctttgttatccgactttttaaacttccccacccatctgtcatctctgtttatctctgtgtattacattcaagctctccaagacaaagcatctgattggattagttatttattatccatctaagggtaatgccatctcacaggccacaggccagactgtaaactaggctttcttgacctgggcactattggcatttggggccagataattagtggaatgctggctctgaaaagtgtatttttacactactcagaaaatgaaggcatttgtgagtttggcctggggtagcattttgtcatctgtcctagaatacaaagctttgcgcaacagaaatggtgggatcacacctctgtgggcaaaaattattgggggctgtcctgtgcattatctctggcctctactcactacatgccagtagcactcccctcccttagctgtgacaaccaaaaatgtctccagacattgtctgtctgatgtcccctgttgggtgaaattgcccctagttgagaatcactcctttataccaatgcctgcacaatttgtggtaatgaaagtcatgtggaacactaaatacagtgacctatgcctgaggaattatttgaagttgcttttctgcatccttagggaccctttagtctctcgatgaaagggagtgtcctcagcagacaatcttcaggaattgcatcagctgcctcacccaagatcataccccttacaggggcagctcttcctgatcagtgtaggggaataatgacctggccattttggcccaactcaggagaacattaacattctagctcaagagctcccatggggttgaatgagactgtcactgggtctgcattcaccttgacttctccctatttctattcctgtttctttcacttcccttccacagttgtctatcctgctctctaatcattgccttagagttggcttcctggaggaagccaatctgtgagggggcaatgaaattgacaggcatttagaagcatctaagaaaaaggtattataataggcccattacagtcactgggtaatttgatttactcttgctttcataatgaggttgattattttgttcaggataagtagtgattattattatttaaggtgtccaacctcatgatctccattaataggtaaggactttggggacagcataaaattacatgaatctcttaccttaaaccttaagctcagcagcatacatgcccatgacaggcaagagttagaacgtaagatggtcagtaacatagatcttgaaaggaaatatgttggagtgtgagcactttaagggcatagggcctgcattacttttttattaaaaataattttgcatctaacacaacatcttgcatattagatgcaggatatgccttgattgaatgaataactgggcacttaaaagattgttcccagtctaataaaatgaaagaacttagcctggtgcttagtctaatgtccagaaagagttaatgaacttcactttatcttcagtcagttaagaattgattcactttgttactcaacaaatgtctgttgaatgaccaatgtaaatcaaactctgatctaggaactggggaaacggcagtaaataaaacaaagtttatttattgtggagcttacattttaacaagagaagatggacaatcaggtcatgataagtttgatttaaaaacaaagaataaagcaggctaaaggggctagaggatgggagaaggggacccttttagtggagtggtcaggaatggtgacatttcagtagagatgtgaggaagtacaccagtcagatattgggggacaaagtgttccaggtggaggaaacagtaaaagtaaaggatccaagatggagcatgcttagagggtttgagaaatattaatagcaaggaagccagtatgactgaagccaaggaagaaagatggtgaatgataggaggtcagtgagtgaccaagggccagacgaggaagggtcttatcaactatggttggctatcgttaaaagcctttggcatatatgctttgtgagaagggaagtcatagaattctgagctaagaagtgacatggtgcctgtagcattgttacttactgtgcctgtagtattcattcattcattcctatatttattaacaaaaacgagtcacctgaaatatgaagataaaaagagaattattgccttgggacatttaaataccaatcacaaaagacagacctataaaaaatgacctcctacagtggtagtaaatagtgggtgcaatgggagtagaatggaagggaggaatccattccacagtgagagaaaggagatgttctatctagttgagtattaacgcatattgtccctgaggctacatgcaaatccaaagtagagggtattccttttgataggaacttagcaaagaatgtttataattgcttggtccctgatctcacctagcaagagtcacaagatgcattcagtgatgaaaaatcagtttctcccttctacttagccattctgataagatgaatatctcgggccgggcgcggtggctcacgcctgtgatcccagcactttgggaggccaaggtgggtggatcacctgaggtcaggagttcaagaccagcctgaccaacatggtgaaaccccgtctctactgaaaaatacaaaagttagctgggcatggtgacaggcacctgtaatcccagctacttgggaggctgaggcaggagaattgcttgaacccaggaggcggaggttgcagtgagccgagatcgcgccattgcgctccagcctgggtgacggagcaagactctgtatccaaaaaaaaaaaaaaagatgaatatctccctttccagtttcgtgtgtagtctccttaccgcccttctgttcagaaaagggatttcttacgtatgtataatgaatataaatataggttttagagagcactaatgttttaatgagatagaaataggcagacgagagagaataattgaaggattagtcaacatgagggcaatttgatagggaaagaaaaagtctgagcaggaaatgtctgtggaaaaaaaaaatcgaagaggaatggaatgaaatgagctcatttatggtgtgagttagggacagaagggatttattctcaggaggtgaaaagtgaaggagttcatgttatagaattcgacctagaccagctatcaagggaaagaaagtaattcaaaagacttggtccaggagatctggagcagatacatctattagaggaagattcagttttgaactgcatcttcagttattcctggaacccaacacaaaagctcatgacaaccttgttatcttcaggcaaaaaaaaaaaaaaaaaaaaaaaaaaggcgggggcagcaaggcttatgtcttaaacaagacagcacataacttcaggtcagagaattccattaacatgaatcacccacaccaatttaaataggaaaaaaaatagtaagcttggttatgtaaaaatttagtttaaaaatcagaaccaacaattgaaattaaacaagaatgttttatttatttctaaaaatatttagctatttattttgaattctgaagcaatactaatatagtatataatgataaaacacagttgattttcatagtaaacatcagcatcagaatgccaagaggaagatttgtctccgttcatgttttattactctgagaaccgcgtaacattttttaaagagtcagaaaatggctagaaaaagaggaagaaagattatttccttaactagttccctggtcccatgctttggtggttaacagtcagtttaactctagaaccatggaaagtctctgtcactttcctggttaccctgggattcctcacattggcagtaagttcgtgaatgagataaatatcctgataactagctacattaatgatgaaaataattataaacgtaggagttggaatttttaaaaagtatcgagcgctctgtgctcttaacacagaggaagcattttgcatagattaacccgtttaatcctcacaccaacctttaaaataaggactgttattgtctccatttcacagaagagaaaactgagactagaacaatttactaacatattcaagttcatacttgtaactattatggattatcagccttagaaaaggggttccagacaccagtgaatagcaacccacacgtctcaactgcacagaccaaagaggatgataatccccattaatctttgcatgttagtagaggcagtggctagtaacaaatgggagagactttggctggaggatattttttattctttaatctttatgatactgtttcccctctccccttctctctctactcctctctctgtcagctgtatccacaataatgccacaatataactactatacaagaatataaagcttctgttctcatgcttatgggtctacaggtcaactgtaattcgggtgatctggataaaacttgactggaaagctctacttcatactgaagcatgcctgggttcgcctctaggctgtgagttcagtttagatggtttctaaatgtgttgggttgtgagccccagactaaaggatcagaagcaacctggggcatgttctcatggcagattgccagtgtgacaagcctctgttcacatcatatctgctaaagcaagtcacatggtcaagcaagccaaggtcaaggagctaggaagcacactgcgctcaccatgaggccatggctaaggtatacatgtttagttctttcacaactgagtgaaaaatgggccccaaattcaatctctcctatactctttttgcgttaattgctagttctttctcactcttctcgctttctaatggatgtacatcccatctatgatcatttggtttttaatatctgagttgctccctactgtctcaggtttcaaattttactttccttgaaatttccctggtgcctaatacaatacctttcacacagagagcgttcagcaaatggtgtggactgcctgtcgtcttttaaaagtacatctgcagagacagtaaaggcacctggcgatattgcattgacttgttagtaacctgacttaacccagatggcccaaagactgtaaccaccattacctggaggaaagttccctggtaatgcagtcagccaattatgttcgaatttactcgaaaattccttgagcataaattattcatggctctatttatgtaggtatctatcttcctatatctgaccttaggaagcttgattgctttcttactcttctaataatcaccgtgatgtttttgaagttttctataagtcggttagaagcagcttttttttctttttttttttcatgagtaatgccgcccaactttggctattagactttgtgtgactgtgcagccatcagcactggatattagatatagttttatctctgcaactcagtcaccttgccaagaattttagtatgaactcttgacttcccagatcaaatgtgagcctgatactctaaatgacttggcaatctactgacaaatcccatggtgtggtattctgttcaccatgtgcaatggtctcagagctcagcattatctgtctgacagctcatataatatttacaggttgttattcgttaggaattttagttagccataaagattttcacagctatggcagacattagaggtctcattcatcactcttgtgaccttcctctctggaatgtagcccatctgtctctgctgttgaaatctttatggaaagtctgcccatctttgaaagtttagtaagtgatcttaaagttttcattgaatctttacttttgatatacgatatagacatataaagcactatccttattttaatttaacgttttgaaaagtgttaaatttaacttggcctttcatttaaatgacagaaaacttactcttgctacaggaactatatgcgtcacatcaaaagaaaatagaaatcatacagaaaaaaattggaatgggaaaaattacacatatatacatatatattcaacactaataactacatgaaagcttaaatactgtattataatcctgattatgactttaggaaatgaaaacgatagaaatacattttgcatataatttaacgttataaagaaaccctaagcaaattcagtaatgaagtgaactgaataggctgggttacagagcacaagagagggatgaccaacaatcagatgttgcccctttccatttctgttttcctctttttatacacaacttctcaaatgcttgcttcccctccgtctactccctccttcagcctctgatcactagtgtgaaattgcccttttgaggtcaccagtgatcgtgggatcaaatacatcttcttcttctacacccttagtctgtcaggctcaagaattgcttatacttcaccagctaggctgttcttgtgtttcatcccactttattctagcttctgtattatttttctttgacagcagttctactgccaccgccatttgggggcatttgccagggtacattcccttttgttttcctccactgtactcatctttttttttttttgtacttttatagctttcttggggtataattatatgcaaaaatatgcatatttaatatatgtaatttggtaagtttggacatatgtatacacccaagatactattgccacagtcaaactaaagataacgaacatattcattacctacaaaagttttgtgtccctttgcttttgtgtgtgtctgtgcatggcaagaacacaacatgagatggaccctcttttttttttttttttttttttttttttttgagatggaatcttgctctgtcgccaggctggagtgcagtggcacgatctcagctgactgcaacctccacctcccaggttcaagcgattctcctgcctcagcctcccgagtagctgggactataggtgcgcgccacctcgcccagctaatttttgtatttttagtagagatggggtttcaccacatcggccaggatggtctcgatctcttgacctcgtgatctgctcaccttggcctcccaaagtgctgggattacaggggtgagccaccgcgcccggccgaggtggaccctcttaatccccttaagttttaagtgcactacacagtattgttaactataggcactatgttgtacagcagatctctagaacttactcatcttgcataagtgaaactttatactcattgaataacaatttctcgtttcccctgccctgtcttctggcaaccacttttctatttactgcttctatgaggttgactatttcagacacttcataaaagtggagtcatacagcatttatccttctatgactggcttatttcactgagcatgtctgcaaggcccatccacattgtcaccaatggtaggaaccttcttttttttaatgctgaatggtattccattgtatgaaaatgtggtgtatacatgcagttctctttgtacgatcttccttccttaaagagtccagccattctcatagcatctgctatgattctagtacttatggtcttgtcctttcacttgcatttcagtgaaaagaaccaaacttatgctgatgcaaatacctgtacacaaatgttgataccagctttattcatgattgccaaatgctaatcagtctatgggcctctgattttcactgcataaaatatagactaatctgtttatcattcatgctgatgaatggtggataaatggtctagctaagaatgaaagatctgttgtatagatgtcattggtctaggaagacagagatgtagaaagaagtaccataagcccaggcagttagatactattcaaaggcatttctctctgccatactttatactacatgtggcacattaacagtagttaggagtggattcaaggctgcagataaatgctgcccaggtgagagagaaagaattggttccacaattaaccatcattcagacaacacatcatagctatgtgattacaaacattatttgtgtggtgattaacattttacaaagcaatttcatattgatttcctcattttatcctgacaacattttggtgagggagatatcattattcccattggaatataaggaaaataaggcttaggcaggaaaaagactagcttaagatcatgaagtgataggggagtcaggactcaaatccagttcttctgaatctgtactctggacattttctgctatatccagctccctctcaagatgctggattgggctttgaaatagaaagccaacatcctgagtgcctttctaaactctgagttttacagtctatcaggggaagaggagagtgtgagaggaatgttcccaaataatctactgtatcaagcagtatatctaacttgctttgagaattatgccaactaaatactattgacctgcagaaaattgatttttctctttacacttatatcaataaagagaggcttctgctgccataagtgtaatttatgtaaaatgtttttaaaacattcatagcctttaatcaagtaaatatacttctaggaattttgctttaaaaaagtaactaaaatatgtgcaaagatttatctacaaagatgttcactgtggccttacttagaacagtgaaaaactggagacaacttatatgttcccaaagagggaatttattcaataaatcatggtacatccataagtgggaattttttagcaatgaaaaatctgttgtaaccctacaagcccactcttaagcattcatcttagagaaatgaaaacttatgcttatgcaaacacctgtacacaaatgttgataccagctttattcatgattgccaaatgctaaaagcaacctaatgtctttgaacaggtgaatggataactaagctgtagtacacccatataatggcatactacttagcaatgaaaagaaacaaatcgttgatacagcaatatggattatgcattatgctgagtgaaataaaccagtatcaaaaggttacatactgtatttatatgacattctggaaaagacaaaacaagtctagtagatcctccctaatgccttttgttcaaccccagaggtgagttttctattttacctccagtgattgctgtatcggttatttatctaaactgtccccacttttttgacccacctatgttatcaaactccaaatccaccaagtatgagaaaagtagagagatgaatgaaggtatttgtgttggaattccagaaagtgctcttttggcatgtcttaaaataacattagcattctttttaattttctggttaggcccctatgttgattaaaatatgacttaacaccagggtgcatcacttggaacattctgttcatcatgcatttaaaaacggctgaaataacaacttcccctaaataatgtggcctgtgcttgtgattttcaaaactaccttgggcacaatattgaatcctgtcacctcaaggaaggaaaagcatttgaagatagaattgctaccctttcttgctcttaataacatactgtgtctgtaacacaaaaggaaattcagaggttggttttgcaataaataaatgcatgtgtagtttgctatctaaattcagtggacaataccccatgatgctggtgccgtatgataatggttgatttgtacattcaagaatctgaatcacaaagctgccctggaattacacgtagtggttataagcacatctgtataagaaaataccaaaggacaacccggtgtcatatagaaactatttgccgataaatttgcttttgatgggctactaaaaatggacacatcaggcataaaagatgtgtgtgtctattacgtaggctagctttatgaagaatgacaagcttccactggtacactgagataagaaacagctgttgttggcatcagtactgctacaagaaatgaaaaaattctgtggcacacttgtgagcactgccacatatttgatcaacttttgaatagatggaagaccagaatcatctggcagccccaaatgaaattgtcgacaacccttaagaatctcttgagaaggagcactgaacccaattccgtagaactatcatccaattgtgtgttatttctaaagcaagtagttccagtgtgtgtgtatgtgattatgatggggcagggaaggaatgaggggaggctgttgttattttcctttttttttttttttttattgtgtcaaggacatttttgagcataaaattgtaaggtttcaaacaatgactgcaaagcagttgcttaggtgaatttataaactgtgaatcaaaggggaaaaacatctttcagaaaaaaaatacactgaatctcaccattggacctatttgatggctacacataagacaaaaagcttttttaaggaaaataaatgaacacttaagaactgcaattacaaaagcttgaaatttcatattgatctagaatttataatatttttaaaattctttaaaaatattttcagctatttagttcaagcatattctgataacttctctgacatttaattgaaaattttccccttttaatgtaaacataaaaagtcaactctagataccctacgtaggtcttcccattagctcagccaggcaacgccaattttcctctgtctctcgctgcttagaggttgtttctttcaggccgaaagcccctaagccaggccaggcagccagcagccctctccagcacacttctttctgagagacgcctaagaatagtgtaggaaatccaaagtgattcttctgctatcagaggatggtctagcatcctccaaattagaaagaatttctggaccactagaatgataaaaaaaaaaaaaaactagaaaggtataataagagaaattgtgaggcctcagcccatagatacctttaaggaaagaatagccattcttttctcagtttaggtattcacaggcttggcattcacagccagtgagggctggaccaagagctctctggagttctcttcttccttttatgatgctggtattttaagaagaaggtacactgagcagccaggagctataatttctggctctccaccatgtttcctgctatagagggctagctttttaatatttccataacaacagactctgaccagataggtcaggaagtctagcccatggtttgtttgtttgtttgtttgtttttcagttggagttttgctcttgtcgcccaggctggagtgcagtggtgcgatttcagctcactgcatcctttgcctcctgggttcaagtgattttcctgcctcagtctcccgagtagctgggattacaggcacctgccaccatgcccggctttttttttttttttttttttggtatttttagtagagatagcgtttcctcatgttggccaggctggtcttgaactcctgaactcagatgatctgcctgcctcagcctcccaaagtgttgggattacaggcgtgagccaccacgcctggccttagcccatgtttttaaatcagatcttatttactctgtgaacttatttggacaggagagctgcatcctacagaagaaaaaaggacaagagaagagttgggaagagaatgagaaaggcaaagatggaaagggaagcagggaaggcaggaggaagggaaaagaaaggaatagagaaagaaggacagaaagaaatggaaagtcagagactacttcaaaacagcagctaaatgtcttttttctctgtattaaaaatttccgtctgccaaaatgaaaaagcataattaccggccaaatacaaatccatttcctatatcgtttaaatgacatatctccaaggtacaaaacagcatgtctggttaaaggttgggtgatttgatccctctattactctatataaaacaaagaagctggagtttcattacgcttaaattgtctggcagtgggtgaagttaacttttattagaagctgttctttcatattatacagtgtagtcgaggatatattagctttgacgttttcttacatctcaatacactgcggagtgaatttactgtgagactaatttaaaagggagtttttcataggaggaaataatggtcagcatcagctgtgcttcaaattattagcagaatgaaaattcaggggaaaaagtatagacacataaagttgctagatattaataagaatgcgtcttttatttctgtttctgataatattctgtgtttcttaaagctccagtgtcttaaaactatattcaggaggaagattatattgttgaggaaatgttatagtgcctcctcaacaagattattttgtcttaaagaaagaaaaaaaaccatcagatcaaacagtatataaaatatatttgtagaggttcagctttagggaagaaatcctacaacttaagcctgaaaaaaaaaaaaacaatgcaaagatcattcatttgaccaatacacagtgaagtcataataaaacaaattcctagtatgtgaaatgaaatttcacgtataggattcatcactcataacaaaagtcttattacgctctgatatcagtagacattccctcacttttggtcaccttttctaataagatcacactggtcagctgacattttgaggcaccaaattaagcatctatttggtaagtgaatttggattctctttaaaccaataaagataaaaacaaccatatcagagtgataagcatattactttagcttcaataacttagaatgtaaatatatcacagagggatatttcagctactgaaataataaaatccagtcagtcaaatagtaaaaaatattgagaaccagcaacaggaagtattataaaaaaaagcactcaagggagacacatacaagaaaccccgtcagtctactcattcagtttcttatctgttctataggtttagcagtggaaatgtttgtgggttttttttttcttcgcatttatctttgtgcctgaatgagttcagtttcgcttagattaggacagaaatttcagaacagcaggttaatccatcctgtcttcatgggcagctgagcaaacagaccaatatcagtgtaaaattgtaattctggagattaatgttgtctttcctgtttgcgatgaatttgacctccttgcctttctttttttcctcccttcttttcagcgtctgtccagggtccctgggagagagccatctcgccaaacaaagtgccctactatatcaagtaagttggaagtatcacatttttaaaagagcatttattgtgactaacctgtatattcacaagtgagtttatttttaaaatgcgacattagcctggcctacaatacctgtgtcttttttttcctgaggaagcttggataaaaaacttattctaaaattaccattgtaaatttgctgatgcaatggggaacgacttttaagaaaagtttatttaatgcaggatatatggtgtgttttgtgacagagggggcggatttttcacaatagaaccaaaagctccagataattttattgatagtgggagtcaatctttgcgagaacaatttcttttatttaggggttttctcacatttcttcttccgtcaaagatagaagatttccgcagttatatgtacacaactgttttgggtgaatgaatactacatgtttccaaaaggcagaaagcagcagtcctcgactcgtagggcttagttgttcattcttgatacataacactcagtatttgtcacctaacaacagaaagatactgttttctggaaacatttgtgccagtcaaaagaatacgagtgcttggaagcaccttctgtagtattttgcatgaaatataaatgacaatacattgggtcaacgtggaagagagaggagagaggatattgagtgattacgataccttcacagtctctcatccattgtgcactagagtctaacttaaatttaactttgaattggaaacctcaacaacaattacaatttactgggttcataaaatagtcctcgataccaaccgaagtctttgaacttgcttctgccatgagtctgactaaaaatattagatgttttcccatttttttccgcctgccatcttttatcgaatctgtttttattctttcactgtccatcaattcttcttaattcggttctaaagcaataacagcagtcctagatcttcattactacagtcctcaagaaatttgattttatgcctctattttgttaactcagaaaaatgggagtgaaggtagtcttttgactctttcaggagaaatacatactttaggaaacggtttaccatttgtcttattacatttttccagatgaggtatctcttaacttgaaaattcttttttagtatgtttgattctgctttttagttttcatattttatgaatttaattttattattgttatatttaattcattagtcactcaaaactgtacattttaaatacctatttaaatcacatgctttattaaataatatattgctgtagacatgcactgtatattaccttacatccactgtatattttatggaacaattttcttcaaactctagacagtgatttcctacatcagtgtctttgtcctcacaaatttttatttccgactaagatgtttgagacctgctacttcttcaaccaattcataaagctctcacttttatccaattcctttatgagctgaaataaagactctttttctcctttcatagatgaggttttaggatcactggagaattcaagacacctttaagctattattctccaaatgactacttgtttggggctcactagaggtctcacatggattgctagggtctccccggtcccattgtcctttccctatatattcatcttctccctgatgttacttctactacaagagatcccagtacattgctgtgagggaatggaaatgaactccgtccaaaaaataataaagagacaaattccagaaaagctgtaattcccttctgtgtattagtctcttgctgtttctcagtggaattagagagcagctacatatcctatttgtccaatgctccttcatgtacctaaagaccatggtgatggtattgataagggcacagatctatgaataagaaaacttcaattttagtcctccagtctagtcttagaggctctgtcattaggcgactgtatggctttaggcaagtcacttaacctataaaaatcttggtttctttctttttttttttttttttttttttttttgagatggagtttcactctgttgcccaggctggagtgcagtggcccgatctcggctcactgcaacccctgcctcccgggttcaagcaattctttcgtcttagctcccgagtagctgagactacaggcacctgccaccatgcttggctaatttttgtatttttagtagagacgaggtttcaccatattggtcaggctcgtctcgaactcctgacctcaggtgatccacccgcctcggcctcccaaagtgctgggattacaggcttgagccaccatgcccagccaaaccttggtttctaatttataaaataaagagttggactagatgatatctaagatcctttttagctctaagacgtaatgagcatgactcattcagttgtcctgtccaaacttaaaaaccgaagatctcagcttttgttcgataatatctttatttttaaaattcattattttaatgaacataatgtaaattcttactttaaaaaacaggaattttatttttccactgtttaattagctttagatatgccctatcaacccactccaatttcaccacacacctctttaaagagctcaaatcttggtatataatttaggattattatgcttcctggctcatgataagagagagagaacaataggcaggaaaatttgccaaaaggtgagtatggagaccttaaaagcctctgaaataatcagttccttgaaatgaggaaattacgtaatttctcaaaaatatctctgaaaccttatggagagcaattctctctacaattataatctctttgaaattagggatggtataatttctcaaatatgagtgtaaaatgttaaactgtaatatagggaaaacatacatgtttataaaatgaacattgtcagtaagcagatgattaatggcacttgtgtcttattagccattactattatctaaaatgttctatggaaaccaaattaatttgatgtacaaggttcggtggactttatgcacagcttaatgccgttcataatctgagatgccgtcttggtctaaaaagaacaaaaatacgtttacagtgacagtgcttcaaccagtcctcatttttcctcttttttatcttgtttgtcttgacttccagtcaagagtttttaccacagatgcccagctgcaaaaccaggtgtcttctctggctatgtttttaatgctttgtaactttttcttttcaatgctgggataaagggatcgcccacataacaagaggtttctataccagtggcacagttcctgttggttgttgaattgtgcactcattcttgagattttaagtcattaacatcttttgctctagtttgcaaatcaggcagtgtttatgcctgcatcctgacatcagcttttcatatgaggctaagaaccttgattttgatacttcaaactacgtgtttgtctagtttatttgtccacagcatacatcattgttacagttttcatattccctctcccttggggctcccttattcctgccagcatctctttcaggttatttgattacagctttcattgccactgaaaaaataatcaccaacaatgttcaacctgttacaactgccttttctactctctgccattttgtagttttttggcctactgtcaaactcatgaaaatttcaatataatagcctttaaccagctgctgcattctgttaggatttctttcacctttttatgttgcatgctcccatatgggtaaaccaaacagagccaagagctgggactctcttgctttcttaatgagttagaaaattgttcttctgtattctggactgtcaaaagaatttaggaatcccaaacatgcatgcaggatgttccagtatagatgtcataataaaagcataagaaatatcacactgggtcagaccaacagggcaactagcccggaactctgtcccagatgaagataccaatggttgttttgtcaggtaacctagtacattttaccttaaaaattcggatacatcatgaccacttcttaataatgcattgtaaatcaactggcagtgagtttatccaatggtgtcaaacttttcctattccccacttcagctttgtcttaataataatatgttccataaatgtaccgacttctatataaatataggcattttaatttctcttgaatctgcatcctttaacctcaaggaatggccttaattaaattctttgaaattcagtaaaaacatttatatttatccagagtcgactttagcctcacattcccctactaatgcttttcattttcatcttcccagtctgagaaattctaatcctttttagtcttttagtctgtccttgacggaaagataagctttccccttgattatcttagttgtttttccctggatcttttccagctctgttatatcttctttgggatgtcgtgactagggtggcccaaatattggttatgaaatttgttagcattgtctctagtttccactcactcatgaagaaagtaaatgttatttgctgtctcccattggtgcagaaatggagagatcaattgaggtcataacctcttctgcatatattagttctagccgaaggttggttttctgctacttttctgtaataccagcaaaagtgtttgaccttatatttctgccagctgtcccttaggaaggatttgatttttagacaagctggtcctttcctccttcaaagacgctgtggttgctaaatattgggaagaattcactaatgaaactcaggagtaaacctgctgactccatcagcagtaatgcatttcatcaggttccctttcgaaatatctctgaagcccttcacagaagagtgaaagatggggttcttgggaacttgctaactgctcagctttttttacatgcaatgctcaagaagcaactcatgtccaaaggagtgtttatcttttcctgctggtaattttgaatgttgtatatacattgctgtatatgttgcctgatgaccttgatcgacccttctcttcactctcaatctcaggcatgtttccacaaccatttattgcatctgagttttgctcacaactttctgctgcttcctgcttagcaaaatgcgatataaaaccttattggatgaagttaacagttgcttcagtcaacatttcttgttactgttgctgtttgtgctgacaaaattgctgatttgggttctgactgtcctgtcttcttatggcctaccattcctatagctctatttgtacgagtatttgactctctgcctggaactgtggccatctgtctagatttaccttttggtatatgtggctctctgtatcctgttggtctacattctggtttgaactcacggatcttggtctggtttttagtaccagtgttcccctaactccagtagcatctgaatcttgacaccaccttcccctgccccctactgtattgcctctattactactttcatggcaattttttcggattccaaatatgtcccatgcttaaagcatatcttgctctcattcttgttctagcccctgttggtaccaggcattgctccaattcaagttttggttggttgatttcttccttcataatattgattgctatttcagtacctgtatttatatacagagggagcagtgcctaactacatcttagccttaacagcaatcaacgtgttaaatatccctgtgttggctggtttgcagtagacacgtcttctgacaatgagatgggctcttattataaagaaactggagtatgatatcaacatagaaaacatttcctcaggccgggtgcggtggctcacgcctgtaatcccagcactttgggaggctgaggcaggcagatcacgaggtcaggagatggagaccatcctggctaacatggtgaaaccccgtctctactaaaaatacaaaaaattagctgggcgtggtggcgggcgcctgtagtcccagctacttgggaggctgaggcaggagaatggcgtaaacccgggaagcggagcatgcagtggacgagatcgcgccactgcactccagcctgggtgacagagcaagactctgcctcaaaaaaaaaaaaaaaaaaaaatttcctcatttcttattccagacacctcactcttctaagaatgatacaagtcttctgacattgggtttgaaaatcagttgaattttgtcataatctttcatacaatgtgaacacatcatgtagtatataattttgtgctatttctggtaagatccttcttatgtatatttttcttcaaaatataccttttagcagctaagacaacattaaataggggaaattttaaataggctaggcatcgcaagacttgaattctagttccagctttactgtcacctagctattaatacttgaccaatgggaaattgcttattttctgtgggcctcagtttctccctctgtcatttaaggaagcagaatgacatgatatcataggtcatttccagtactaacattttctgattttgtgaatgttgacttcgaaatagaaattgtttgtgatcattttccagagaagtgaaaatgaatcttcatattgcccttgaggattcttattgcaccatcaatcttatcgggatagaaaggacaaataatattaaatgtttcacttaactatttagcactattgatgataagaagtggatgcaacagagaatcagctgtctaatttgatctgtcagtctttgaggatgctggtgaatgattcggggtaattaaatttttgaaatcactgccaaaagcctgatgctctgacttttcaaaaggctttagtacacaaagataacccagaggtcaatcttctctgctgtgttttctcctctgccatttgatggtttcaaaggtcacgttacctgagtctcagtaagctctggaaccacaatgaaggaatagttggtaatacattattgatgatataatcatgaaaacaattcaggttaagatattaactgaaagagagtgaaaggggtgccatagtgttgtgcagagtgctgagtctggttttggttttatagatcttgttgggagatgtagatgttgatatcatctgtgtctcataggttcatgaaaaaaaccctcacatccttttttgtagtttcataagctgatttgtatcaccttgactgaaataacagactccaggaggatagctgttgttatctctttttctagcatagtgcctcacagataacaggtacttggtaaatattggaatgaattcatgaacatatgtcagtaattctatgtgcttttcagtttgctgactcatttcaccttcaaaacaatcttgtagtatttgtgtgtcaatttagatttaccactcaaatccatctctcatgccctctagacatgaactttagtgttaggaagcatgccgagtgtttgatagagtttctcatagctcctacagtttggtgcttaagggacagtccttggcatggatgtatgaatggtacataccaaaacatgagttctagattccgttctatcttaatctaacaatatgataaggagtataacttagctcaacctcaatgagaaggttgaactagataatgcctgggaccactctcagctctagctttgtttcagtagaactagagtctgtttttcctaaatatcattcatgaggcttcttctggttttctagtggtcaatagagctttaaattgatcaactactgtttttcactgagcattgtggacaggacctactttttgggccaggatatagtagccactgagtcttaacagaatgtcatcaatgatacatttttattttacagaaaaatgttgtaacattctatatggcatatgtcatgtggaaaggtggcaacatatatacatacacctatacatgtggcagctaaaatttaatgtgtgtatggggaaaataatcctgtattataatacacatggtatagcattccctgcctcattcgtggcacttttggaaatgtgagaatgagcatagaacatattcaagttggtttatccaaaagaagaggagtaaattatttcagctatttccccattttctttttctaactttcttaaacatgcactttcttacataatcacgtgttagaaaaaaaccagtagtcacatcaaataaatctgcatttgaaacaactgtatcatatcccaactctgttcgtttgagccatttgcttaacgtgacacccattctactttatgacacataaggaatattgcttaagaaatgttaattggctttccttttctcctctgaaactggattgaagtcttattgacctctattagatactgagtgttcaggtttttaggaaaacactcatagagatatagccccagtgtgagctgcatttttagaatattttctagaacccaaatatgtccctaatcaaagttagtttattttcattcttagcgttcccacgtaatttggggtatgtgtgaattcccaaacattcccgggcctctcctaggcttctctaattgcttcttattctgttcccctgggaagcagcatcctgttcccttcacaaaggtcagcagcaacagcccaggcaatgttttaaaataacttaataaccctgaactgcctctctcttctttgggataatttccttagagcattagtcctttgaacactgacctggttgcagaaaatgcccctttctcagtgggaaaactccaaatcccattcagtcttcccctccttccttccaggggatagggtgggggagtagggggtagggagagggtattaaatactttcttcaggaaaaatgttaacacggtaaaacactctctctctctctctctctctctctctctctctctctgtgtatgtattcttttttaaagaaatagactgtgagtgcattgtataaatcagtgctgtcacgttgcaaattttttaaaccgttgtacaagatagaaaaacagtatctctggatattgactctggaaagcttctaagagcaggtcctagatgagacttagctcactgtcggcattcggcaaatgatcacgttttctgtgataccattaactcctggggggatgaaactgaaaagcctcgctgctcttcctgaaactctcaactgcttttttctgtttttctttctcagcttatccacatccatcttggtccccaaagccattgcatgtcagatggtcagtgcaatgtgtaatttttaacttgcttctttgttgctttagaaggaatcgttttgttgttttctttccttttggtcactatttcttgttcatgagttttctgtaaacagtgtgtctcatagataagtccatgtaatctgctagacaggaagaaaagcaaagtttaatgtgtgcctactatgtgctaaatgacaaagtgtttcatctgtatcttcccatttaatccttgtaacactccacttattatccaataaagaaaaaaacggctatcagtcgggcgtggtggctcatgcctgtaatcccagcactttggcaggccaaggtgggtggatcacttgagctcagcagttcaagaccagcctgggcaacatggcgaaaccccatctctaccaaagatacaaaacagtagctgaatgtagtggcatgcacctgtggtcccagctactcaggaggctggggcaggggaatcccttgaaccagggaggcggaggttgcagtgagccgagatcacaccactgcactccagcctgggtgacagagtgagaccccatctcaaaataaataaataaataaaagttaaaaaaaaaaaaaaggaagaaacagctgagattcaaaaaagttggaggcttatccaagtcattctaataaaggggaggggggagaattgatacttaaaatcatcatgataagaaggatagacattggagattcagaagggcagaatgctgggtgaggggtggataatgagacattacttaatgggtacaaggtgcactactttggtgatggatacactaaaagcccaggttcaccactatgcaatacatccctgtaacaaaactgcacttgtacctcagaaatttatacgaataaaaataaataaatcaaataaaataatcatcatcatctcagctattgcttctagctgtttcaactttctaatgtttttgattgaaaactggccatttgtataaccaaatgtggccaatccaccactgtgaggctgccatcttgggcatcaccaaaactactctagtagtccttccctgcactgttaggtggattttccttggcgtatcttcgcaatcaagttgcagagacctaagttactctttgctgctttgggcaataaaggggaacaaaaaacaaaatgaaacaaaaacttggccagccctgatgtaagcactcttctacctccctgcaggctgagaaaacaaagtatttcttttttttttttttaatttttaaaatgtttgattctggtctaaatcaattaaaatgagatctccccccttcttttttctttttttcttctaaaaaaaaaaaacacaccaaaaaaccgagatacatgtgcagaacgtgcaggtttgttacataggtatatgtatgccatggtggtctgctgcacctaatgacccatcgtctaagttccctcccttcaacccccaaaccccaacaggccctggtgtgcattgtttccctctctgtgtccatgtgttcttaatgttcaactctcacttgtgagtgagaacatgcagcgtttggttttctgttcctgtgttagtttgctgaggatgatggcttccagtttcatgtccctgcaaaggacgtgatctcattcctttttatggctgcgtagtattccatggtttatatgtaccacattttctttatccagtctatcattgatgggcatttgggttggttccatgtctttgctattgtaaatagtgctgcaataaacatacatatgcatgtgtctttatagtagaatgatttatattcctttgggtgtatacccagtaatgggatggctgggccaaatggtatttctggttctagatccttgaggaattgccatactgttttccacaatggttgaactaatttacattcccatcaacagttcaaaagcgttcccatttctccacagcctagccagcatctgttgtttcctgactttttaataatcaccattctgactggtgtgagatggtatctcattgtggttttcatttgcatttctctgatgatcagtgatgttgagctttttttcatatgtttgttggccatgtaaatgtcttcttttgagaagtgtctgttcatatcctttgcccactttttgatagggttgtttgtctttttcttgtgaatatgtttaagttccttgtaaattctggatattagacctttgtcagatgggtagattgaaaaaatgttttcccattctgtaggttgcctattcactttgatgatagtttcttttgctgtgcagaagctctttagtttaattagattccatttctcaattttgtcttttgttgcagttgcttttggcgtttttgtcatgaagtctttgcccatgcctatgtcttaaatggtattgcctaggtttccttctagggtttttaggatttggggttttacatttaagtctttaatccatcttgagttaatttttgtgtaagctgtaagggaggggtccagtttctgttttctgcatatggctagagagttttcccagcaccgtttactgaataggagatcctttccccattgcttgtttttgtcaggtttatcaaagatcagatgtttgtagatgtgtggtattatttctgaggtctttcatggataggaagaatcaatatcgtgaaaatggttatactgcccaaagtaatttatagattcaatgctattcccatcaaactaccatgaccttcttcacagaattaaaaaaaaaactgttttaaatttcatgtggaatcaaagaagaccccgtatagccaagacaattctaagcaaaaagaacaaagctagaggcatcacaccacctgaattcaaactatactacaaggctacagtaaccaaaacagcatggtactggtaccaaaacagacatatagaccaatggagcagaaaagcaaaggatttctaagtcatattccaccacctccatcagggcttccctaagatagagagtatggccaagaccatacttaataaatgtcatggaatgtgtttctcttcataccctcaattgtaagtctttctgaaaggtagcgcgtggtcaatttagatggacaagaagtgctctgcaggagcctttgcaacatttgtgcatgtccttgattttgacaccaccccccgccccccattccagaacagatcgtctcatccttcccttaagccagaggcctatggttctagctttactaggcaaatatatatggtctgtggctataagtcacaatttctcccaagccttgagctgggggaatactgagtctgcccatgtattacatgcagaacatttcatcttattgcagaatgatactttattcttattgcagaatgatattcattattgcagagtgatattctttagtctttattttttatcattataactacatggtgcaaaagaagtatttctcatactttttctcataatgactcaaaattacaaaagcaatctgggcaattaatatgtttttgaagataaataatggcttatgttttctgaagattaagaaaaatctctgtctgaatatagctgggcacagtgtctcaagcgtgtaatcccagcactttggggggtcaaagcagaaggaacacttaagcccaggagttcgaagccagcctgagcaacaaaatgatacctggtctctacaaaaaaaaaaaaaaaaaaatccttggcatggtggcatgtgcttgtggtcccaggcacacaggatgctgaggcaggaggattgcttgagcccagggggccgaaagttgaggctatagtgaaccgtgtttgtgccactgcactccagcttgggcaacacagcaagactctgtctctaggaataaaaaaaaaagaagaaagaaaagaaaaatctctatccgaaaaatgtaggcaccctgtgttaatatgtaaatacaagtgctttatcaaataaaggctagattaattgttttttctcgctcttacttatatcaatactacaagaacttttctgccaaaaaaaaaaatcaaataatagaaaagaatgaatcctagatagagcaggaggggctgagcaggcacagcaaaagttcaaggtggaaatatctttatgcatccaattaaaagtaatttgtgtacattttactcatatatctatatgtacacatacatacatacacagacacacacacatatatatatatatatatatggagagagagagagagagagagagagagaggacaacgaagaggaaactaaagagaataaagggtattaacagcaggtctgtgacttattccctgggggatgtgaagggaataaatgaccttaatagaccacttcataaacatgttaatgacctcccagaccttcttgtttatcttgttaatagtggttaactagaggaaagatacctgcaaatccctatctataaaatgattttagtagggtatacctggcctggctagatagcttattgtaaataaacctggaatgtttggatttatgagtcgtggctggctggagaatagggcatagctacatgaacgtttttctatttttgtaattgacagattataaaatggaaaacttttgagactgaaatgatttcctttcaatgtttctgtgtaaatttttaaaaacgtatctgttaatatgaaaccaaagcacatcataatgggaaataacatggatgttttggaaacgcatgtgtgattatttcaggttccccagggaaataatgttctatctgtgcccagcacttccctataattctttcagtcattaataaagattggtactagataagaatctgagatttgtgtgagtctgatgtgagatccaaatgttatacttacacaatttgtgtttattttagtttaaaaattatctttgccatgagcaagaggggaaaaaaaggaggatgagcgggcctacatatttttccttaacatcttgtcccaagttttaggaaatcacaagtctaagaaaaggccagggtcaggactaggaagtgatataacagttatacatgtctacctttaaaattatataagtaataattaatttttaaccttattttaagcagatcctagaaatagcaagagcctctataacgtcccagctaagaccccaagttttctttcttgtttaactcttgaaatattttgttaattttcagatcccttgtctcctcagttcagctgtaaactctctgacaacgcttgtgccttatgcatctttgcatcatccctagcatgtattatatatctcacatgtaaaaataataataaatacttgatcatttgttttgattttgatgattaagcactggaagctgagctatgatcccaataggtatgcttatttaaagaaaaatagatggcagtccaggcgtggtggctcacacctgtaatcctagcactttgggaggctgaggtgggcaaatcacctgaggtcaggagttcaagaccagcctgtccaagatggtgaaccccgtctctactaaaaatacaaaaattagtctggtgtggtggcagatgcctgtaatccccactactcaggaggctgaggcaggagaatcacttgaaccctggaggcagaggttgcagtgagccgagatcgcaccattgcacttcagccagggcgacagagttgagactccatctccaaagaaaaaaaaaatcacacacaaaaaaatagatggcacggcacagcagcttatgcctgcagtcccaacactttgggaagccgaagcaggaagatcacttgagtccaggagtttgagaccaggctgagcaatatagcaagactccatctagaaataaataaataaataaataatttttaaaaaatagacaataacagataaagaagttccatgttatttttttaaattctagatagccccactggtgttacagtttattaaattacatttggaagcgattttttagcagtccatttattttgtatatttcagtttgttgagagcagatggggttgagtgttgatggggttgattgcctggctagattatgctataaactataaatctttgaaagttactgttttgaagaaagcatctttaagtgaatatattccttcagtagctcctattaccaaaactgttgtgagaatatcttaggaaaacaccttaaaatcctcttctatcaaaactcccaagctttcttcaggagccagcattgttcagtgaatgcatgtaagcctatgtcttaatagagggatccctaacctctggaccatggactggaacagcaggaggtgagtggtgagcaagtgaacattactgcctgagctctgcctcctgtcagatcagtcgtggcattagattatcgtaggtgcacaagccctattgtgaactatgtatgcgagggatctaggttgtgacctctttatgagaaactaatgcctgatgatctgaggtggaacggtttcatctcgaaaccatacccccgcccctgcctcccagtctgtggaaaaattgtcttccagaaaactcatgcctggtgccaaaaaggctggggaccactgtcttaatagatcttgaaaaaagttggagtaaggtaagtggtaaatcctaagacatacattgaggcagagctgcagtggtatccagtagggaagaaaagacttcaagtttagaattcagttatactcaaccagtttttgcctttctctgttaaatattagatatcattaccagacacatacaaaagattttaattgcatgaatgcccgatgttgatacaagagagccgatttttttttcacacatagttttttggggtttttttggtagggagaaacatcatctcatgatatcgttttaaaggtgctttattatcaaggaccttagagctttttctctcactcatatttcatatactcttagtcctcaagccatttctttttactgaaagcactatagagtagcaaaaggcatcattatattgctcagcctcattcatcatcaacaaaattgccaattatattccaagtccttgaatgtattgtttaaaaagatgtataaggtgaaaggaagcagttcaatgttgaggtggaagatgaaacatactgactggtagattcagagcatactaatcttgttttcacttgtgaactggaaaaaattaacatggagggatggagaaaacatgttcaaactacaaagtcattttttctgagaagttatctgactgtaactgtaactgtaactataactcagggtatatcagagggctcaaatgtggaacacttctttaaaattaaaacctaaaagtcctgatgtgtaatagaacgtgtaaaaatagcagcctctgaaggatctgagatgagcagaggaacactgaataatataatctgacagtatgggccatacccttacagtagttgccgtggcctggaaactatagaattaattcagtaaaacatcagaaaaaaagcaacataaatataaaatattttaaattaaaaagactgaataagaacagaaaaaaatcccctagcaaatcaatattgcttggggaagcatgaatcccagaccagcaatattttaatccaaataacttttagttccatcgtgaacacctttatcaccaagttttataaagagtggagtgaagaaaaaaagtacttgaggttgttggaaacacttctcaaagttggtggctttattcagagattcatgcttgactgtaccaacttctgtttaatttatacgtagtactttgtcaatttaggaatttggtttacttgtcctttcctaaatatgtgtattacaaaacaaaaaatagagaaatgataaaataattacaaagatgattaagcaatagtgttggctatagtgaacagattattgccattttatagagtaataatatacctaaggaaatctgtgggaaatttaatttgggatataaaacacagaagtcaggcggagatgaaataataaaccaataggaaattaaatttaggcatgagagtccaaagatgtaaattctatagatgttataaaataatatgtatgcccttacataatttcattactctctgaacttcatttctcagtgaaatatggggaaatgatactgaacagtgcagcagctcttccgcttatgaaccaaccagaagatatataaacaactcttaagggttatacattataaagatataatttagtctggatttttttttaaatttgaaaactaattttatataaaccctaattgggcaattctccattctttgacttgaatattatagtaaatatgttttcccaatttccaagtttcatgtattattttcaaagaaaaaagacaaacttttaaatgtccagctacctgggacttcctctgattatcttttaaggtagttcaaatatatacaatttcaaacaacaacaacaacagcaaaaaatattttgccagacaatatgtcttgtttgtttttaatgttcacaatgtaaagtacacttattgccaaacctcactttcaatggtgttacaaattagccaagtataactagtttgtaaatactaataagaaggttgctgaaattcagccctgaatatttcttttctgcaactccaaagaggaaaatttttgaaatgcaaaccttgacctttatcaaagcctaggtgaagtttgttggaggtgtttggttttttgctggtgctttgttataatgcagtttgaaagtagactagattggcaagacataattggctgctgtgtggagaatgcatttggtggaacacgtgagttaggggtgaggaaatatgaagagccagagtggaagcagggagaccagatagtagtgtgggaagcactggtgttagataagatctagataaaggtagcagtggagatcacaagaggtggttggaatcagggaatatggtttagaaacaatcacaggtcttgctgatgcattggaggtcaggagggacagaaagagggcaatccaggtgtctcctcggctttcagcaggaacaggtacttaaagaggaacaaatttggtagggaaaatcaagttttagtgttccattgcagtacatggtaaccatggctaataataatgtctcatatatttcaaaattgctaaaagaatagatttttaatgttctcaccgcaaaaaataaatgatatgttggtgaggtaatggatacgttaattagcttgatcaactctttctacaatatataccaagatcaaaacatcacatcgtatcccataaatatacaaactattatttgtcaattacaaataaatgaaataaataattttttaaagagatgtcttaaagggtggcttgaagagcttctgtgctccaataatacctgcccattagccatactttgcttccagcaacaacaggaaaacatttaatctaaacaaaaaaaaattgcttgtcaactagatagctactcttccgtgtagaaaccctagagctgcctgggtttagacatgtttaagtttgaggtacttattgggtatctagctgtgcagttcaaaatttggatctgaagctaggggaagacgtcaggacaagagctttaacttttgtaatcatcaatatatacatccttcttagagtcatggggtgggatgccatcatattgggatgagggaggaaaccctgggacttcacaatatcgagctagtttctgttttgcaaaaggcaaatgtattaatgaattcattacattaattaagcaaactatatttattgggggctattgtaccagctattgtaaattttatattttatattatatatatatatatataaaatgctcacaaaataaaggaactaagtcataaatatgcatatgatttacataaaggagctaaaataaggatctctgtttctgtttcaattctttattaaagatctatctaagactataaagacatatataacaaggtacaggaggtaaagagtatattcttaggcatctaaaaatttttcctatgcttttgaaatctgtgtgatttactttcttgaattggcctgtaatataggagtacaatatcattgcagagattaattagtgtgtttgtgaactgttctcaaatgctaaaatgaaagcataaaactataaaatggcatcattattccttaaagaagcatagtttccaagggtgtctctgatcattgtcacagcataaatgaccaatttcacccataattagccaagttagtaagaagttattttttactgggtatattttgtttaacctcagttatatttgtaaaagtagaaactgctacttgttactgctttcagaatttctcacaaatgctaaaatgctttttaattctaatgcacttaaatggtttgattctccttacctaagaaaaacatttatctaaagatatactcttgactgattcattcattgattcatttgtcaatagatgtttatttatcagaatatgtgcaccagatacattgctagatgtaaagggtacatttggtgagcaacatgcatgatacctccaaagtatagccagggaatagataatggaaatgacactaagaatgaatacatattaacacaaaaagagagagagagtcatgtgtcaaggcaatttagcaggagggaacttgtcaatacaagggattaaaaggacagcatgactagggctggaggaggtgaggagaaaactcaaaaagtcctctggctgatgcaaatgaattggatgaggagcctatgaatacaaacgtttgaaggttactgatgaaagccaggtgagagaagatgggatttggaccaagatgatgatagtttggatatggtgagaaaggcatagatttgagagatttttaggaggtaaaaatccttaagatttgaggatagatatcataggaggaagggcgcaaagagaaagcaaaacatgtcaaggaatcacacctagatttctgggcaatgcacagttggtaattctttacagtgagttagggaactctaaagaaagatcagatttagggtggcaatttgattgtaaatgtttggatttcaaatgattggtgacatccaaaaagcactgtaaatagacagatagtgtgcacctaaagaaagaaggaggcgcatctgggttggagtcactaatttacatattacttgtatatagctagtaactgaaaccatgagtgtgaatgagattctgatgctaaattctggaaggtcactttttaaagtgttttgctttttgaagtacaggtgcaatactaaaaataaaaaagactaatttttaaaaattaaattaaaatgaaaagcctggaaagataaacaccaaagttatgatactagttgtagtatgggagagggggcatcagagaggatcggaatttcatcttgaatggtgtattttatttcaaaagaagctttgagcaaagataaaatgttaattctgagcattagaaggaacacatttgtttttttgtactgtggatctttttgtatttcctagaactcttaatctaaatcaaatattgcaaaatatatcactgtaaacaactggttggtcactagctttttaaatactttgtagcaacttggttgcttgtcagaggtcttctttgagtgaagtctttaatttatagttctttatgcttgatcagcataattgcaccaaactgttacttaatctgaaaaatagctgtttcctagagccctacttaatactgaaaacctactgtgtttgtattgcaattgcatttttttttttacttttccccctgcttttcagtttgtataatttctgttaccctatattcaagttcactggttctttccttgtctttgttgaatctacagatgagcccatctaaggtatttttcttttctgttactgcttttaatttctagcatttccatttgattcacttatagtttccagctctatactgaaatatactgaaatatagagctggaaactataagagtgaatcaaatctaatcttgcatattgtcttctaatcttacatattttctatctaatcttgcatattgtctttcttttccctcaagagtctttaaaatattaattatggttattttaaatttcctgtctgatagttccaacaactgttacatatctaagtctggttctgattcttgctttgtctccttagactgtgatttttcttgcttaggcatgctttgtatctcaggggtaaaagtcaggcatcttagatagcgtaatagatactgaggtaaataaacctttgacatggtaatttatcttaatctgactgggaattgggctgtgtttgatgttggtagttgctttggttgtcattgttgagttttgttgctgctgtggccaccagagacttcaaattcctctggtaactttgtttcctcattggaagcttgttagtgtagtggttgagtgtcgggcagaggcattctctaatgtttgaattaatacacagttggcctgggtcttggggatgtggtctttacaattatttctttcccttcctccagaggtagagtaacttcaacctcccattcccttcctggagctgcagtggatatccaccagtgttctcagtctatggccccaaggccctttctcctgcataaggctgaaaaacaacaacaacaacaaacaaacaaaaaaaaacaaacaaaaaaagaacaaaacaaaaccacacatagatgagatctggtgttcccttcccctaaaatgcagtggtatttcctcagtgcctgatatggtttggttctgtgtctccacccaaatgtcatgtcaaattgtaatccccacatgttggaggaggggcctgatgggaggtgaatgaatcatgggggcagatttctccgttgctgtacttgtgatagtgagtgagttctcaagagatctagttatttgagagtatgtaggactttccccttcactgtgtctatcctgctgctgtgtgaagatgtgcttgcttcccctttgccttctgccatgattttaagcttcctgagggctccccagccatgcctcctatacagcctgcagaactgtgagtcaattaaacctctttgctttataaactacccagtcacgggtagttctttatagcaatgtgatgtcttttcctctgaagagaagggtataagcagattcatggtgactagctactgtgacccttccccaatcagcaacacagagggtgttggggaggctttctccagattcttcgcatcctccttgtgaaggcaaggtacagttcctgaaggaagaagcttgcaaaaggttgggactccacctatggcagtagcccccaggatcttcacactctcaggctagctcccacatgtcccccaacaatttaatctccctactagtttatatggcatctgctccagggatccaaatgctcaggcactgcttctggctaaaggccaatctctctccagatttcaggttgttctataatgtcatttctctgatggactgatgaaaagtcattaatttatctgtccagcagttttcttgctacaagtatgggagcaacctctttgcagctctccatctccatctccaagttgaaactggaagtctgagcaatacattttagaaattaatatttgtaagttttccgtgtcataacaaaaataataaatgttcactgtggaaaacatagaaaaagattaaaaatatttaagtgcccatcaccacctagacaactgcaatgaacatgttggtaatgtcttcttccagttttttaaaatctgctgataaaatacaaaagatattgtttatataactttgtatcctaccttttcttgagcaatgcaagtttaaacctaaatacgaagatactctaacttcctactttacatttttgacggcagatgtcagctgtcttcccaagtgcagtacccttggcttaatatcaggtagacaaataaggccaccacaaattcacctttcacctcaataacacaggtaatttgatagttctacagaccctataatattacttgactgaagacccagaatacaagtctttcaaggattactctagaaactatataaagtattggtatcatctcccttcatcatatcttgccaaatccaacaggtttggaacttctgtaggaagatttttgtaacatgaaaaatgcgtgttgcaccttccatatccagcaaatacaccatcggttttttgttggctgcaccaatgacataaaatgatttcactgaatagggggtgacccagaatggaaatgtagagcatcgaaaataaaatcaaccgacgcagtctttgcagcaaaccatgtggaaacaaatttaaatatggaacatactctttccaactcatcttcagatgttgctttaaaatttgtgcaggtgaaaaaaaaatctttattttaaggtaactcaatcttttaccattggagagaatagaattatttttgtttcctcttgtatattcccagttgtttaaatgttctctgtttccttgtgtggacacataaatccaaatatatctaatatcaaggtatttaccatatgcagcactttttcctcagatagttattttttgaaatattcaaatagcttacctgtatcatcccccccatccttttttttttttttttttttttttaagacggagtcttcctctgtcaccaggctggagtgcagtggtgcgatctcggctcactgcaacctccacctcccaggttcaagcgattctcctgcctcagcctcccaagtagctgggactacagttgcatgccaccatacccagctaatttttgtatttttagtagagacagggtttcaccaatttggccaggatggtcttgatctcttgacctcatgatccacccacctcagcgtcccaaagtgctgggattacaggcgtgagccatcacacccagcctaccctattttctaaacgaacaattagttgacttttcttcagttcttactcagaaatatctgaccctaggttccaacttttgttttgctctttgcagttagtttttatgtgtactgttagggagatgtgctttttttttaccttcaaatttaaaagagagagttttcaattccttttaagtcaaaatacaactgttctactctaaagctttctttaaaaaaagaaaagtaccaaatcctcatccgtagtaattaattttgacagtgtaggctcagtagtgattcacaaacctgtattttgtgcatcagcattccttattattctaattaaagtggaacattgtgccctcgctaatcattaatgggttttcattttgtaaatgacatttgcagaagttaaaacagcgagttcatgtgaagtccacaggcaacggtgttgaaattagcatcaccatagcaacagtcttccatcattagcattcagggcaacaggaggtgttttgttgtgttttgtttcccaaaaaaagaaaaagaaaaaaacttcaaaggtaaagcctacagaaactctctcagaagatatttatgttccttgtgtgtatgtgtactgtactagacctctaagtctacatagaattttttttaaaaattgcaatgtggatcatctcctttccagatttgtgttttgcctagtatactagctaaatttcatgatctttctccagctgtacacgtctgacctgctgagcagcatttactcattgccaacctgctgctcaccaatagggtttcctacgtggatgaagagagtctgtattcatgaaaatatttggttcaatctaaaagtattatgtgtattcatgagtttttaatttaattcatggaaaatagatttatgctgttagatcctctggtgaactcatttagtcatgttgtagatataggtcaatgattattctcattcatgtttagacggaattaaagaggagtcaaatagagaacaatattatcttaactgagtctctggcagtggtattaccactattactctgtatgtgtgtgtgtgtatgtgtgtgtgtgtgtgtgtgtatgtgtgtgtgtgtgtgtgtttgaattctaatattctgggaaactttaaaagtggcatatctagcacttatgtttttctcagtactaaaatgcataaaagagcaccatattgacctaccagctgcttctaaatcacaccagtagtaggtaattatgaaattcaaatgaagtttaattttcatttattatacaaaaatgtcatagctcaaacccagaagtgttacccccaagcttggatatagacaggtatgtgtgtacattttacttttcaagatgaatcatagcagtcttctccattacatgtaaggactagaagttgtacattccactcaggtacctaaaggcaagcctgtgctagcccacactaacaaagcaaaatgaagcaaaggatctatctggctttcaatcagggatgcatctatgctatcatcagctctgtcacataataaatgagtctatagataacttgaactactcagccaatgggctgtaacccagtgattctgtggtattgaaaggcagcaacccccagaagccacatgtctcagtgtgcactccaggactgtaggcccatagaacttgtatgtatgcacacatgcatatgcattccccacttttctaatggcgatccaatctaggcctaatccacagctagtccagaaaagaacttttttaggttttctgtctgccatcactttgttgagaggcagtacaagccaagcaggtgtctgtatttataatatgcacaatgttaggataactcaaactcataagggaaagattaatggctgactactatgaaaaccgcttctagccttgtgataccagcacctactatcttcctttttctcttatatgatgaaaagatttcaatgttggcttttcattctgatagaatgtgcaagccaaaatctaaataaagtccagtggcaatgatccccttaaacattatatctttcttctcgatatgctgatgttttcccttataaaaatctatgtaagtttcaagatttatatgacagacaaaccacacaaacaggaggtccctcacattcactactagtcacttgctctatcactctgggaatagcggtcttcagattgcatctctactctacctcttgctcttttcaacccctctcctcttttttagaccatacagggcatcagacaaggtttagtttaccactaaactttgggatttggaagatggtgtataaactgatacaggtagtccactcacagatgtagtatataattacagacttgagttttcaggggctcttctccagtttcctgtcaatcaatttccctggctgagacattagcatttgtcagtgaccatgcttactatatacatacacaattgtgtatacacaattgtaaaattaaatacgggctttagaagagattattttttcttaagagtaggttactctataaatgccaaagcatgtgttatgacatagaaattcaaatgactaagaatagctaattgtttagaaacatcttacttgatgtctattgttccaaaatttgatccaatttagagtggtaccaatccatggtgtagaatataaaagctaaaggataacaaaaatcctaggaatctcatgccagtaagaaagttctaccagtcagatgagatgttgagagcatttatgacttggcatcaggaatattataagtaaaattcatgtgagcagtaattgcagctatgaaccatgttatttgttcccacttgtccaactgtaattctttcacttagctcagagtagttctttgtaacattagggcccactcatctgcctttaggtagggttttaaaagatgcctagaaaatagttctgtgctagaaatcagagactcttgacctactgtaaagggagcagtaagcacgtttcctcaggagaatctttctacatactgcagattcccataaaaatctttgtgacaaaattgcctttactgaaaccatcatccattggattaaaaaatagcttaccattagctttttgaaaatagaaaacgttgagccttttcaatgatactttcaatagtttttcacaactatgagtcctcaagctatcagtcttatttttagataccatacttataagatagttatagaatttatagagtatggtttaaaagactattcaattatagagcaatcattcagtttattcccatggcagaagtaaatggaaaccactccagatcaacaagaatctactctcttctgattcagaaaagagatttcctatcttttcatgaataatccatgttcaatgtttaacacctcaggaagattttcttaatagcttcttctggtcataaatccttggtctgtcatcagggacatattgaagagttagttaccaaagttcttaatgtctcccattgtaaaaaaaaaaaaaaaaaaaagtcactttttggattgtttctttcatagagtccatgcttctgtacgcttaatactttagcttttgacttcaagctttaggtaatgcaaatgaagctattacatcaccaaagttaaatttttcttgtaagtatattctcaacattcacaattgagagctgcctcttctttggctggtataaggttttaatttattgtagcactttcaccctagaatggcaaaaaatgttgaaatcaattccatatatcaccaatacaaagtactaagtcaaggccgggtgtggtggctacgcctgtaatgcaagcactttgggaggccaaggcgggcagatcacttgatgtcaggagttcgagaccagcctgaccaacatggtgaaaccccatctctactaaaaatacaaacattagccaggcgttcatagcgagcgcttgtaatcccagctacttgggaggctgaggcaggagaatcgcttggacttgggaggtggaggttgcagtgagccaagatcatgccattgcactctagcctgggtgacagagcgagtctcaacaaacaaacaaacaaaaatattgaattgtacaccttaaatgggcgaatcgtatggtatgtatactaaatgtcaataaagctgttatatgaaaaaaaaatgctaacacacacattctgaaagtatattaaaagcaaacctacggccgggcgcggtggctcacacctgtaatcccagcactttgtgaggccgaggtgggcggatcacaaggtcgggagatcgagatcatcctggctaacacggtgaaacccagtctctactaaaaatacaaaaaattagccaggtgtggtggtggacgcctgtagtcccagatactcgggaggctgaggcaggagaatggcgtgaacccggggctggagcttgcagtgagccgagatcgcgctactgcactacagcctgggcaacagagtgagactccatctcaaaagaaaaaataaaaataaaaaagcaaacctacaatgtctcttacaaacacaggcaactattcaattccgagtttacactactgaaacacacatgaatatgacactaagagaatcacgtggatctgcactcttcaatcaacactacgtctctgagcacaagaattttacatctgatttccatttggggaaatagattcagaatgccataaaccagatacttcttgccttcctttagtggtcatttctgccattatcatttaagggaatggatctccttctcccaaaactgttaccctaagattacaagcttgtcctttaacttatctctgaaagcacacctctataacgggtcatcagtattcagtcagctaattagactgcagaagtacgtttactcaaatgtgaggagataaaattgtgaaatgtaagaggaagaaagaatgtcaaagataatccaacccaaactcttcatcttacagataggaaaatggaagtccaaaaggggaaagtaattttagtaacatggctaaactggtctagaaaaccagatcttctgatacctgatcccatggtctttctaatgccatggatgttcgggtagaggatatattcaggtagataacttatagatagccccatgtgtttgtatagcactttatcgaacactttcacctctattatcacacttgattcttacaatatcccatggaatgtttgagtatcatatatgattattcttattcccacagacttggaaactgaggctttgagatgtctggatctatcttagatcatttgctatggactagaatctgggactaagttgcttttgtctaagctgtgtgtttgttctgttgtgccgtattgttaattcatttctgttggtaaacaacacaaaggaaaaacttctataattatgtttctttttcatcctcaggtcatctatcctactttttatctaagctttggaaaatattatgtgctttccttttttttgtattttcttttcgtagagatggcagcagggggtagtctcaccatgttgcccaggctgacctcgaactccttggctcaagcgatcctcctgccttggcatcccaaagtgctgggattacaggcgtgagccaccacacctggcctattatgtcctttctttagcttgctcgtttaaccatttgtttggcagggggagtcagaactgtgttttacttagtcgattaactgataggacaatttaatatctaccctgcactggcagtaacccccatagccccgctctgtgtctcattctgtgccctgaacaaccttgtcttaaaaacattttaaaagcagcaagtatggggagatttcttatctccatataatacagaagcaagtgtagagtatggctacggaaaacaaccagcaggtgaggctgtgacataacaattttaacccaagcctcactgccacattgaggtatccttgttcaataaatagatcagaaaatatggtgtagtttttccctaacgctgtctaaacagcaacaacaaaaaatcattacccatagtatttcagtaatgtgttgtattgaatgcattgttttcgagggcgttttcaaaaaataagttgattgaatctcttttttttgcttgaagaatgacccacattcagaaagtatacagatgaaacatgttcagctcaatgcaattatcacaaaatgaatacacctatgttcgccatctaggacagtaaataaaacattatcagtagccctaaaccagattacacacacacacacacacacacacacacacacacacacacactaaaccagactacacacacacacacacacacacacacacaccgggttgggggagtggtgagagagagagagagaaagcgaatattatgttaacagttggggagtctaagtgaatggtttatgggtgttcttttaacatttcaattggtttaaaattttcaaaatgaaaagcttgaggagaaacatagaatataaccactacctcagaaatcaccaccctacctcacccacattccctctcccaatcactattcctccctcatcttaaaggtaactgctactctgccttataacactatggttgagttttgcctgtttatttgaactctataaaaatggaattgtacagtatataaccttttgtatctaggactcaacattgtgtttatgagattaactcatgttgttgcatgaatctgtcatacattttcattgcaatttgatatcccatttaaaatgtatactataatttatccattctattgttggggaacattttggttctttccagtttgaagacattatgaataaggcctcctatgaacattctttaatgcgttttttggcacacacgtgtgtacaactgtgtttggtatatactttgcagtaaaattgcctatgttgagggtaggcatatgctgagctttagtagatactcctggttttccaaagtggttgtaccagtttacaccatcattagcagtatatgaaagttctagtagctccacatctcaacaatacttgatacttgttagtctttaaaattttcgccattgcagtgagtgtgtgagtagaatctcattgttattttaatttgcaattgtctgattacttatgaggttgaatatttttacgtgtatttattgaccattttggatatcctgttgtgtgaagtatctattcagtctcttgcctattttttttattgattcatccttctttttcttattgatctgtaggagttttttttacatattctagtttgtagccctttgtaaattgtatgtgttgcaaatatcttctcccattttatagctttccttttaattaaattgtttttttgattgatagttcttaactttaatatagtccaatatgtaaatttttccttagggttaattcttttgtgtcctctttaagaaatctttcctaatacaagataatgaatgtatcctcttttattatcttctagaaacttactattttttaacttttccatttagatatatagtacacctggaattgaccttttgtgtaatatgtgagatagagattgagttttatttttcataatatggatatctagttggcccagtacttgatgctaaacattcatttagaattcatttgatagtatttcctttagagttattgcatctgtgtttattagttatattggtctgccattcttgtcaaggtttggtatgtggattattctggtttcataaaggcaagtagggaagcattgcctcttctagtctctggaagagtttctttaagattggtatttctgccagtgatatgatttggccttggaattttcctagtgggaaaatttataattacagtgtttatttcttaaatagtacagggctattccaattttctatttcttcttttgtcagtgtcagttgacttaaagcacactaagatactctaagattgctatggtcagcctttgctggtctaaaccagaggttgcaaactgaaatgccaacagaggggctagcctgctactgtaactgggcaaggctagcgaagcgtaagttaatgggagctggtagggactatagaatacatgtgccgttatagaatggtggctccggaaagttattgtcatgcaagaataggagcccagcatggacaaatcattccttttaaatgagaagtcagaaggttggattattctgtaaaatatctctgaatatttaaatgttgagtaattcagattaaaaaaaaaaaaactgtgtgggctaatcaaaacatttgtgcatgccaaatttagcccaaagtctgctagtttgcaacttgtactttcaactaatgaaaagcgtaatagcacagatataattccattttcaaataatataattcatttatagttgacatttatttaatttacacttaaatatgaatttgtcatttaatttaccatattaaaaaagtttagattttaagacatccaagtctgcaaataactagaatattttcatttactctcatgtttgtgtacttatttttccttaaatgttattttcatgatatacttagtgtcttgtggacattccaaaaaactgatttgacttaaattgtcctcactccaagctttaaaattgcttagttcatagcctaccttgcctaaagcaaacctggtagtctcatttcaagttactggattttttgtttgtttgtttgtttgcttttgccttgtttcttttcaaggttatatagagtgaaggaatatcagacttcttttaatttttgcagggaattcagattgctgtggattaagatcctatatataagatgcttaggatagaggcatcatgaatgaaaaattattcatatgaacacactttttagagtattatttttattcattcagcaaataatcatagctgccatactaggcaggtagggaccatgaagactactgtccttgtagtctaaagtcttgtagactaataagatatgtataactgttaaatagtacactgaaaatacaaccttaaacaatcaaaatatttgcaaattgtatttagttgacatgattgcataattgtatttatgtgacaattatatttgttattcacatatttagggagtcaatatgtacttaaggtaatctttgagctattttcaggatgaggtattagctcattactattaatactaccatcaccaaatgcattacctacttatctgcatttccaggaaaaattcaggaaattaggatttttaaaataataaaataatagtaaataagactgggcatggtggctcatgcctgtagtcctagcactttgggaggccgaggcgggtagattgcttgatgccaggagttcaagaccagcctggccaacatggctaaaccccatctctactaaaaatataaaaatcagccaggcatggtggcgtgcacctgtaatcccagctactcgggaggctgaggcatgagaattgcttgaacccaggaggcggaggttgcagtgagcagagatcatgccactgcactccagcctgggcgacagagtgagactctgtctcaaataataataataataataataataataataataataaacagaataataacctaagtgactatatttgatatatagttaagtgatgtttttgtagactttactaaactaaaaaataaattagcagttatttaattttctagtttataaagtacctacttacataaagttgcatatattacttcatttaattttaaaagaatatcgtaaaatatgtaggatagatttccattttatagtcaacaatacttattatttcaatacattatgtgattttttttcccccagtatcacagtgttagagcccaggttcaaaccagcattttctaactgtaagtctggaagtctgtctgcttactctatgtaagatgccttatgaagttcatagaggagacagctcagtggattcaggcctggtcttatattttgctgttcatcttgttttaagtgttatgttaagcaaataaaacataactttaaacattctgtttacttttaaaatttgatttagagctaacaaaaattagaatttgtactccatttacaacgaacagaacaaccaaataagcaaaattgtatttgcgttgtcaattacaataaataattataatggtatatcagagtgttaaattttgatttttttttttttgagatggattttattttattttttattttttttttttttgctctgtcacccaggctggagtgcagtggactgcaacctccacctgctgggttcaagtgattctcccgcctcagcctctcgagtggctgggattacaggcacccgccatcatgcccagctaatttttgtatttttatagagatagagtttcaccatgttggccaggttggtctcaaactcctggccttagatgatccacccgcctcgacctcccaacgtgccaggattacagatgtgagccgccacacctagactaaaattttatgttcttatatttctttaaggaaagcaaaaatgttgacagagagggttaatactagttatatatacaaaaaacctaaaaataagattttggattattctattatatgattattcatttattgaaaatcataaactaattgaatgactgagagcagcactaatgtgattactttggtaggaatctgtcctccaaagttgtcagttgtcagttattcttagcattttgaactgaagtctatgtaattaagtcacctgttgtttctgacaaaatgagcaaacacacataaaatctcttggttcgtcttcatgtctctgtggcagagaactgaccacattattcagttcctttgtcctttttagacaaaagccacctctacatggccctataagtcttcaattcaaggactatagccgttatcttaatgggattgtacttggttatctgataaattgtcgggaacatacccacattgcttcctttacctgacataaaatttagtcagctggggctcaacgattgaccagctttatcttgcacgtagtgaagggaaggactttcttactcctggatgtgcctaaatttaagcctttgaaaaagattgaagataccaattggcctacctgccctaagtagatgcttcccacagacttaactggtgaagtgcttgtctaaggtagacagaattttttctttagagaggagcaaacaaaaacccaaaaatactggcgtgttcttttgatgttctatttcccaattgatttccgggttcacactactccacaacatcttactgtcccattgcatcttaaccctctctcctctcccgcccccactttttttttgtctgtttcttctgcttccaccgttgcttctgctctgaagcaatcattttctctcccttcaaccaagggtggaattggcacacagtcaattggcttgggagactgcttactgatctgtcttttttgaacactggaatcttgacactggttatcattttgaggacagcctggtttggatatttatctattaagaggaatccttaattggtgtctttgactggagtatttgaaggagtctttaattgggaggttttaaggcaccagaaaagattcattaggaatgactgacctcatgttatataaatgagaaatatttaccatttgctgtacacgtaattgaagcatgattatacataaaagcatataattaaaaaatgtaaataaatacctaaataaataaatgcctataactagcatggcaaaggattctgatatcagctttcaatctcttttagtagagactggacaaatcagaaaaagaggatttatacctgtcctcctatagattatgctttcttctcccatcatccagttttaattgaatctcctcattgtgctttctttcaatcttgagctgcacaagttgttttctcctgtcagagcttttaatacacattgacaagaattattagtctctatctgcagttgttccaagtgcaggtttgaaataaggagtcgtcatcaatgtgctaacgcgtgctacttttggtatttatacaaagtgcctgctgccagttacttgccacttagaatgtgtttttcttttcctctcttgcgttgtgggagtagaaggattctctgtttcttttggcagacagagaaattttcagattggggtctaatgaaagaaataggttccattatacagatgtacagatgttctaaggtcacgatacctcctataatattcttatgtgaaacctcctctttatgttcaacctgtgtacgttacacttatacatagcaggcatagtagccatcaatattagttactttaaaacccaggcctcctaggctgtggtttgtactaaaacatcatattcaaataaaagcattccaatacaaagtggagaaacagggacaggcatggtggcttaagcctgtaatcccaacaggctttgggaggccgaggagggcagatcgcttaatcccaggaggtttagaccagcctggccaacatggcgaaacctgtctctactaaaaatacaaaacttagccgggcatggcggcacatgcctgtaatcccagctgtaatcccaggctgagttatgagaatcacttgaacatgggaggcggaggttgcagtgagccgagatcacgccgctgcactccagctttggtaagcctcggtaacagagtgagactctgtctcaaaaaaaagaaagaaaaaacgtgtagaaagaaagagaggatctgattaagctcacaggaacattgcttctcaaattttaatgtgcatacaaattgtctgggaatcttgttaaaatccagattatgagccagtgggtctaaaatgagacatgatgttctgcatttctaacaggtgatgctaatgctgctaatctgtggaccaaccacactttgagaaggaaggaagtagactattatatttactcattcacttgttccatgataactcttaaaacagactggtgactttaatacaattcagagcaccaaataaagattgtcatatgccttatttttaacctatcgtcttatatcaaaattatctgataaacttcccaagtgtgcatatatattgtcattttaaataggtttcaataaaatgaagattcgtgagtaagaatataggaataaatgacattaaaatctttctttataatttatatttctactttcttttgaaagaatttgtagtggcttaaacataagagcacaagatgagccagtgacaggaaaaaccaagtgcatctgacatcttagcttattaggtctagaagacaacctccattacttggtagcaagcggctgggaatattggtgttcaaagctgtgctttcctgaaggcaaaaacagcatcaaaatatgaaaagctttttacttctggcatgagtgataaagatgccgatctgagaagcaggtgaaaaaacttagcttatgcttctaaaggctaattttatataagtgttcttgtccagctgttcttggtaagtccagctgctagttgaacaggacaggtggtaatccctgttcagtggctcattatcacccagaggctttgatctggctaatacataatcaatcagcttctgaatattaatattcttcctattttcatttcacttgttttacctaaatttattttccaaagttccagtatgtttttgttttttaataagatttttgatcatttatttattttgacataactaggctcatgatatgccagctggagtttattacacccctgaatcacaaactttttttcttccctctttatctccttacaagatccaaattgcaaaacctaaggataaagttctaattttggaagcacaaaagactgaaactattttagaggagagcgttaatgaaaatcaatatctaaaatcctcattttaagactgtgaaccctatagtctatacttctagtgtcttcagagttgtgatatgcatacattaaggactaagaaacatttttttaaatagtcagatttgggagcattagatatgtttgtagagggaaaaatcaatttatgataaaaattactgacaatggtttaatttgtattagttttgcccacttccctgttatctcagaatggcacctccatggacagtggaatggtcctaacagcctaaatatggtaagctttaaaaacagatggcttggggccattctgcttattatatcattgctttcaatagcataactgttcttctccaatggccctctttgttgtttgcttcattactggcacatttctttaatatgtaatctataacattaacatgaaaatggctctcaaatactattactttctccatctgtgacccagtactgtttatcatcatctaatgatcattcttattgcagatggccctctttaaatgtttcagaatagcattttaaagacattgagggtgcttcctacgtacattggcagactgaatgttttaatatcgaaaatctcggtctacacgatgtgtgataaatgactggagatgcaaggcaccagtcagttccaaagcaaggtgtaagagggacaggaggagagtgataaaaaagaatacatactttgcgtgtgtgggtgtgggtgtgtgtgtgtgtgtgtgtgtgtgtgtgtgtgtgtgtttaagccattagatttatctttaaggaagcattatctttaaggaaagttggagtaggaagaacaaaatttaatcaaaagaaacagttcttggccagaggaggtggctaatgccggttatccgaacactttgggaggctgaggtgggagcattgcttgaggccagcagttcaagacctgcctagtcaaggtagcgagacaccccacctctgccaaaaaaaagaagaagaagaagaagaagaagaagaagaagaagaagaagaagaagaaacagttcgttattgcagttcttaaagaaggagtttgtgtttcctttctgatcattcaccatggcagtgatacaaaggagtgatatcaaattgataaatgagttccctaaggctcaacatatactaaatgcctatgctgaacttccaggtttcaagtccctagagcctctctgtctgaagatcctatcaccaaggattctttgtcttcatctagtactttctttctcctctctctattctttcctcatttgcggatgcttgctggggcctgtcaatcaaacatagatgatccctgacttacaatggttggatttaggatttttttacttgataatgctgcaaaagtgatacacattcagtagaaaccatacttcaggtatccacacaacccctctgtttttcactttcagtacagtattcaataaattacatgagctattcaatgctttagtataaaataggctttgtgttagatgattttgcccaactgtaggctaacgtaagtgttctgagtaagtttaaggtaggctaggctgagctatgatgttgagtagattaggtatgttaaatgcatttttgacttagaatattttcaacttatgatgagtttattggtacataacctcattgtaagttgaagagcatctgtatctgggttggagcagaagtattgctagtaatgcatccatgagtcaactgtttgcttaattggtatgctaccacacatgtcttgagcttgttcatcccatggcttgccattgtgttggaaaggaaggtgttacagcattgccgttaataacatttctaaatgggaccaaaaacagtattttctttatctgctagatctttttattttcttctttctctgtatacgtgagctgttcccaaaatttagcacacatgttttatgattctcaacataacgtttatggtccttaacattaatctcatattagaaaataaatcatgatgaaggtgaaatatagaccaagcaggggcagttatgaggaccaaatcgtcagtataaaacttttataattaatattttcatgaattgatagcacttgcttcagagagctaaactcagaaaaaagagaaatattctaacctgaaaatatatttttaaaaactcataatttaaggtagggggcaagtagatttggccatattttgggctttcttcaccaattcagacacgataatgactacatttgtatcctagatttaaatttgctagatggaaaagaaacacataaatataaaccccatctgcgcaaacaaacataaccattcacattcttatgcaggattctggggtaggggagggctttttttgtattataacatagcatgttaatttttaagataaaatggaaatatttttgtgcttttgttaatttttatgttaaaaatgacattttaggcacctaatcaaattctctgagttctttcactaaagaattttgcctaatatttgattaaattcattattattaaagatcaatggaatttctttcagtttgaaaagttgaaaaaatgagttgacacattgattcatagaaaaagttatgaaatttgagaaaaattattgaaccaattttatttaaaatacatatagatattatgtgtatctgccttcattttcaggataatgaatgtcagtgttaaatgtggaaacattctaaaattggaaatcagactccacttggttcaaagaacaccttattttagataagccttttaaaataatgattgaaatccagtcaatccataccctcacacataatcctcatgcatgatctttgtttttccctatctctcctctaaatgtcctttacaaagatgagaaatgttcttcccaacacaaaattcctttgattgtatattagaaagaactgacactttgcagcaaggtttaggaaaagctaacgtaagtagagcttctctgaaaactgttttaccaaaacatactggatttactgctgttaaataatggatttttttttttttactatttatatttgctcctcattgaaacttgtaaatgactttattagtcttaggcaacacatttcattttgcattggataaagatgcttcttcagtaaagtgttcatttatagcattgagaatcttgaaatataaccggtgtcatcaaagggtaggaaggtagaggcacagagaagtgattaatcacttttccctccaatgaatgatctactgtcaagttcaataatcatatttcatctataaagagcactttgagcaaagcctgttttgcacacgtcattacatttgattacaattaagtataaatatatgcctattatttagctctagttaaaatctgcaaaaatatagaaggcttgtgggtgatgtaaattggagatttgcataggtttagggtacaatattagaaaacactgtagttttatttttgctttatgactaaaaggcactagctatgttatctcgtttgttcaccaaactaaaaaacaacagctaaaaagcaatgtaacaaatttcctctaaccttcttaacccatccactgctgtcgcatgactctcacaaatcagaaataaagaaccatttctctactgaaggtcatcaactcatttgagggccatagatcagtaaaaaataacttagtctgagacattcaaatcacttgctttttaggtaaatattttggcttttaaaatgacacaaatctgaccaaaatgttactcagctttatgggaacgggattcttttctagataatcttagggacgatcttaactcatattgtttttgttcagagactaggtctaatttgttagaagtgctgccatgggatctcattctactcaacaggagtgcattcttcttatccagtatccactaaaagtcactcctcctcccatgaaaagagttgccagtggaaaactcagagaaaacatgggaagggattggtgatgtcatataaggagattagaaaacatttttttaacgtttaaaaagtaaagagatgaattttaaaatttacaaaccaataagtttgatgttgatgagcaacaaaatcctggaaaatgacatcgtactgattattaatgattacataggataacatgctgctgggaatcagcgtgatactctcaaaatctgccatgtcacatgcacctcattttcattttttttatggctgcttgatggttagatgagaagactgttagagacagcataacttaggattttacaccacatttttcaagttctcttttgagaatattgggtacaagataaagaacagtggggctggctaataggctgaatttgaagctgattaaataatgacatctaaagaatgtcaattaatagatctagatcaacacaaaatagagtctctgtcgttggccctgcctttgcacatggctgtttcttcttcagtcatctcttaagctcaactcagccctctgcctgaagacctcatttggccagttttgcccattcattactactgtgaactctcttttgttatttttttcctgttttattctgagaatggattgagctagatatgtggaagttatgggaaagcatattttaactaaatattaaagaaacttttgtaatcgagctctccaaaaaataaaatccgccactttgaaaagcattaaactccctgtacagtagattttcaagactgaaatgactgtctcacccctaaaggcaatttctgtattggatgagaggatataattcattaacctttaaggtcacttgtgaatctaatgttttgatattttcggaattaatcagaagggaactgacagcatgacctgaatctgtcctatatttatgtaaacatcctgtgtgatgcacctcattctttgtgcagttgtatgcatttttgaatgttaaatttgattttagggcaaacgcttttttaaaaaaattttaaaataaactttattaaataaaaatttacacacagtaaactgcctccatttaaagtggttcagcgatttttggcagatgtgtacttgtgaaaccaccactgcagtcaaatgacagaacgttcttactcccccaaaagcctccttgtgcccctttgcaggtcatttttcctttcacccctgattctaggcaaccactgatcgtctttctctcactgtgtattactttgcattttcaagaattttctataaatagaatcatacagtatttttgtatgtatctggtctcttatattcagcataatgattttgtttccagcttgaggatattatgaataagactgctaaaaattgtatacttgtttttctaaataccccttataaaatcttacttttgagaagcatattactaaaataacttcccaggttatatgtgtatttgttctttctgttcatttcagcattatcttattaacaagcaactggaggacatgcaccaaggataaattgactaggtgctaactgaatttgtgagaaaggcctagtttctaacgttctttcttgggagcagatgtgtaacagctacttttgctgtataacagaccaaccccaaaacttactggcttaacactgaggtcagcaaacattttctgtaaaggacaacatagtaaacactataggctttgtggagcactttgcatctttgttgcacattctttttctttttacaactctaaaaatgtagtcatacttagctgagaggctgtacagaagcaggccatagaccaaatttgaacaatagttcataaactctataacacaatggccagccatttacttagctcactatttgatgggtggattgggccatttatgtggtgtgaccagttgtactactgtttgccaggcatgcttatgcatctgtagtcagctggcagctggataagctatcgtgacctgactcatatgtctgatggttgacaggctgtcatctaggaacagatgcaactaggtttgtgtgtatctcatcatccaacatgctagttcaggctagttcacatggaaacttctcaggtttctgcttgtgtcatgtttggtagtgtccattagccgaagcaagtcatgtcatagggccatcccagatgtaaggagtggggaaagactccacctgttggtgggaagagatacaaaggcacactgcaagagctggacaccaaggagagggctagaacttttggccatgttgcaagatatcacaaaatattcaagaaaagttacaggaaggttcctctgtggactaaattctcttctgaatttagatgtaggtaaaatggagtgtgctgttaaaattcatgctttgtgagtaatcattgctaggctaaactgtttgtggcttcacagccaatggtagacatacagcatccataatctagtgcttttaaaaatataagaaatactgattacaaacatagttaaccacttattagtactgggaatttaatgaaagctgctgtgattaaatactgaaaaaagaaagattgtgggtttccttctggtaactttcaaagctggtcactcttttgaaaggaattttattcttaaagctgttatttttactcataatatgcttaatacccccatggctgcagactgtctaaaatgttcctacaattatatgagaatacttttaaaaatcatgataattatcagtcttcatggacacttattcagattaatttccccaagcacttaataggatgaatttataagcattaaatagaatggggaccatccagccctaaaatgtgaccattctgtcaggcacacacttgccaatttgttggcgtggacctgagcacactagcaaggactttgaattaggtctcactgcaagatggaagcagaagggcatttctcagtttatgttttgaagtgttttgttcagacaggcaacgtgcagttgtgtatagtagtgtgagctacctgttactccccttaacaatacttttagcagcaatgtttttcctcctgcaatgtgacaatatcaccatgccatttggaagaaaacaaaaaggctgagtgattcctggtatactcccaaacagccacccaaacgaacagctggcagagaagacaccccctaaaacttggagcagattctcagcccctgcagcatctcatgtggttagaacttcagacttgatgaacgcctccccaacttgctccccctcctgaatcttttaatcctcctccagtctcttgtaatgttccagcccttaccagggaataagactgcaaactgtcttccgtcaacttctttccaaatcctagtctagagaaattataatgatgcatgattgtccagtgggcatgtatagtttgtccatttctttatgtagtaaagcctgtagctttcatcttttttgccaatccactataaaaattaattttatatgtcatcctggtacacacacacacgcacacacgcatctatatctgtaaatctttttctgtctattcatgcttgtatgattgaaagaaaagtttcacaaaacattacttacccataccaaatagtacactttcatattttttttttttttttaatttcaacttctattttagatacaggaggtacatgtacaggtttgttacatgggaacattgcatgatgctaaggtgtggggctcatgacctgttacccagattgtgagcatagtacccaataggtagttttataacccattttccccactccaacctctacactgtcatattttctattcttttctgtttcattaagaacaatactggtaatgatccactatatagatttcatgacgtactaagggttcatgacctgcagtttgaaaaacactgtagttagttttatctccacctcaggccaggtcatcagaaagctgcattcttagaccactttgccttggcccccataagattgcctcaactcaggtgtacctcggcatcatgttcctggcttatgtcgaggggcactgaaaactgctgaagggatttttctgaaagtcgacaccatgcagtgtctcccaccttagatcccatgcagatctgtttattcaatctaagtcattccagacttggattttcctttgtttcacttacactctttcctccttatcaataatccaaataataaaatcgatcatatttccttttatattttttcttttgctttgacatctacaaaggccacaaccaaattatacccaccttttaaaacacttttttactgaaatatattaggcatgtagaaaataagggagatgctggttaaaggatatgaaacttcggttaggaggaataagttcaagagctctattgtacaccatggtgactataggtaatgaaaatctagtatagtcttgaaaattgctaagagagtagatttaagtattatcaccataagaaatgataagtatatgaggtaatgcatatgttacttagcttggtttagccattccacagtgtatacatatttcaaaacatgttatacatgataaagatatacaatttttatttgtcaattaaaaaaaaagaaaaaatggcttaaacttatacagttcagtgaattttcacaatctgaacacactcatttaaccagcatccaaataaagaaacagaacattaccaacctttagaaggccctttgtgtgcccttctgatagttacctgtcctccaagggtaaccacaatcttgattttgaacaccattaaatattctggcctgttcttgtcctttatataaatgaaattgcacagcatgtactcttttgtgtctgacttctttaaacctggattcatccatgctgttgtatgaagtggtggattgttcattctaattgctatgtaatatcccattgtgtcaatatcctgcagtatattatatactctactgtggatgggcatttggtagaaaaaaatgatgttataaacattctaagacatgccatttgatgaatatatgtatgcattcctttgaggactatatcaaggggtagaatttctgggttatagggtctgtgtgtgttcagcttctgtacattcttccaaacagttttccaatgtggttgtaccagtttgcactcctactaacagagcatgagagttgtagttgctccacatcctttctaaccctgtgttgtttgtcttgctcattctggtgggtatgcatagcaaaattttcataaccacatcatgcactgtgatcttcaaagctgtgttctggctgggcatggtggctcacacctgtaatccctacactttgggaggccaaggtgggctgatcactagaggtcaggagttcgacaccagcccggccaacatggtgaaaccccgtctctaccaaaaatacaaaaaaattagccgggcgtggtggcaggcacctgtaatcccagctacttgggaggctgaggcacgagaattgcttgaagctgggaggcagagtttgcagtgagccgagatcgtgccactgctctccgacctgggtgacagagtgagactccgtctcaaaacaaaaaacaaaaaacaaatctgtgttctaaattttcctcgcttcttaaagttttatgctatttatatttccttagtgctgggttttattaatttttaagagttatacattgttataagttgccctaaagcctttacagaacaatgcacagtataaatatgtacatagtatatacacaaatatgaatccatgaatgcacagctaatagggccattatcaaaaatcctacacttttccttttcctctagccctcacattcaattggctcaaaagtagcattgattttattctataacctgtcatgaattcagcctctccacaaattcccagtgctcctttcttagttcagactttcatccactcttaactgggctgttgtcatcatctacttggcatacatttccattctgatccctaccctcttttccacccttgtttcttcccacctcaaatttaattctattttaaaaagaaagatattcaaaagtacaggtggtgccaattttttcttctctatccatcatatgcaaagaggcttccaattctttgtcgacctgtttctaagggatgagagtaggtcaagctgtgaggacttcaattcccacgtgaaggtcttgttcatattaactcaataatgtgctttgatgtcctaatggggaaagtagtattttctgccagttagccttcccaagatatcaaatccaatattggccaaatacatttttgaattcctaaaaagcctaaactgatgtcgtaacacagctgtatattaacataaaaactctgtaccttagtaaattattaatatgagcgattagctcacagagtcaatgtaagaaacttgtttcaactcttcatattctagcaaaaagaacacacacacacacacacacacacacacacacacacacacacaaaacctgatttaagaactaactaggtgattaaagcctacttagtttttaattgaagtgcatattctctaatcccaagaggccaaactaatcacctttccctttttgctgctttttttctctctatttctgtaattattataatctgtctgatactgtgtttagctatatatgggtctatcttctctcattagatcataagctccttaaggaaaaggccatatttccttgggatcccacttaaaaaaaaactggattacaatgttgaaatttttatatatttccatgtcattctccaaacactccccagtttttaccaaccataaagaaaaaatgagaagagtttaaatgataagcaaatacatatgtaagtgttccataaatacactatgtttgaagttatttaaagaacttaatataggataatatttaatagagaaacttagtctagatagagcacataaaaaacattcttggaaatttgtggataaataaaagttccttgcatctgtattttcctttcatcttgaaaacatgccttgacaaaagtaagccagagctggagtacaagattcagacattggtagatcattaattggttaaactggattttatcttatttccccttttatggatccctgtctttgtgtggaattcctgccacttgctggctgttcaaggcttgccaccaggagactttctccatcaagctaggggatatttctccctcactgtcccccaccaaatcaatattcacttgctctctgactactccaggtttctgctgtctgagaatatgaacatggatataccttttaacatgcgtgaatactattcatattttaatctcggccccactgaatgatagcaaacgctgtgaattttatgcctatctcaggctacagctagtgccttatcttgcacacacacaaaaaaaatcttacttttcctacttgcttccttcttaagtgtaaaaagcaaaaagaggaaaggtgccttttgtaaactgctaaagagcagtttacagaagagcagtttactaaactcagacctctcattttccctcacacgacaatctaaaacagaatgttaaagtgaatttatttggttctgtatacctaactattcctgaacatactgagttctcttttaagaaatcatacctgcctgacaggctgctttgcatgaacacagcattccccagccttcaaattgctgtcagagccgttgtgtcattttgacccacaatatggcagtattatccacattctatagatgagttaacaaaagcttccaagtggttaagtgacttgcctgtaaagggttaagtgacccacctctaaggggtagaattggtctggacactctgcccctctatcttcatgcctttgctataatacacagctacgcttgctgaagattaaggaagctgcttttgataaagcgtgattcttgtagatattcatctcaggaaaaaaaaaaagaaaaacgctggtgtcttcatctgtagcatttgattattacattttccttatctgtttcaacttaggatgacttccttgttcgcttaattgactggtaattcctttgtttacttttttccaaatctcaagaagcaagtctagagtattaacaatggttacattagcatttaaaatttttttttgaaatttgagtatttcagaaaggggtaatttaggcaggcatgtatgtagaactttgcattttaattaaaaagactcaaaatgaaatgaacctctgacagtaacagatgactacttctaaaagctgcattactacttgatatatgctcagtattttcttgtgggtaagtcctacgacttgtttcaagaaaagtgacaggactaaaacaattaaaaaagacaaagctgctgttttttaatcatatgttcataaataaaactaggttgtgaattgtttccagagaagcaattgacaaagtatgagtaaatcactctaagaactaaagctgcgttgattttttttaatgttcaaccaaacatctatccttgtccaatgatgaattttctttgacaaataaatatttacaaagtatgaaatatagactctgtgcctttcctaaggccaaagcatactgtttaaactaaaatttaattttttttctcacctcaaatacaccaaaataagaacataactaaaaattaattctctcttgtagtagactgtccattaatcttttgttagataatattagcattgtgagtgtcaggtagaaagaaaaactgtaatttctagattgatcagaaaatgtgagtatttatggatttgaagaaaacaataaagtctgataaaatagaattttctgtaacctcccttatggagtcaagaaggaggaatctttcaacatcctcccattttgcagtgaaaagtcttcatgcagtaaatagtttgcttgggtagatcaaagggttaatttacttctgatttgagaagagacgcagacttccctgatttttttacaaaaatgtgttgtgtgggaggaaggtagaggcctcagaatgaattcactaattggggttttcacctgctgtgagtctaatcgaatacaaagccttatttgtagctgaagaggaagagagattatgcagagtgtaagaatttctgcccagttttgaaattccgcttatttggcacaatcggtggggaaaggcagacaaatagttacaagtttgagctgttaaggtagaccaggaatgctgtagtcagatatacttgaaccacattaaccagtgatccatttttagcaggaggtggtgtgggtcatatacatgggttatcgctatagctggcaggctaataggtactccaaattctttcccatgaagcaaccgtcggcctgtgaggttaatgaagtatggctttattttagtgaagatgctaaaattcacatctttttagatgttcggcttgatataggtggctctgtgaagctttgagaaatcttattaaaagaaaactgtgtgagagtgaagcagagctcgactttatctggaacctgtctggtgaaatctctggtttagatggcagctggctcacagagaactttcctgagtctggcttactctgcctccctaaagagacagggcctggaaaaataggcttttgtgtgggtgtgaagtgctctgtgtctgaacttagaggcctcttcatttgctggttaatgtgacctggctggatattcttacatccagaagatgttggtttcagattgatctagggggattgttatatatatatttcaattagtatgctataatatttgccctaaccagcaatgattcaccatacaccaacccatttgttagatgtctgagtcactgttcatggttagtacttgtactatgcaaagaggaatatggaattcttatgtctttattgtatacccaaatgctgacattttactatagaatatgtattcgagttaattgaagtgatacctatactctaaatgaatttttataaagtgatgcaggttatactaaaacttagggcgcactatagatagagagaagctgaaccctaggagttggtgaagtctctcgggaccatccctccaggcaagtacccagttcaaaccattccttgtctttgtcctttcctatgccactctgcatttttacacagctagcatcaggccaacattgaaaccacatgcaacccagaaaggaaaaagatgtgtttgtggaaggtaggaacagcctagtttcagctgttggcccttcacagcctccactagatgggctcattcgaacccaagacccttccaacagtacactgcaaatccatagctccaattcagacatcttccctctgagctcaagactcagatgtccaactgtctcttggatacctgcacttttacatcaccacctccaattcattatgttcaagactggattcatcatctctttcctaaccctcttctgccccctcctcctgaaattcctagctcggagaatgctactcatccaatctttgttgtcactcaaggacaatggtccttaaccttcactgcatattagaatcacttggagagtcttagaaatcctaatgtccaagaccaattaaattagaatctcagggtggtgagacccaaacatctaaatttattaacaatccctgagtgattccaaagggcggccaagcttgaggactattgctttacttcttccctctcttccattcatacatccagtcagtcaagactcctgtagttggaaccttattgtatcatttctccacctcctctgccactgctgtaattcagatcctcctcatactgcaatctccttgtacctgatgtctgaatttcagactcttgtcttctgatcaagcccccataccattgcctgagtgatttttctaaaagacaaaccggacagagccacactcatgctttaattctttcttccttaaaaagctccctcatacctttcaggatacaagtcaaactccagattgtcacactaagccctttccagtttgcccatttctctaacccttatcttgacattctctccaaaagatcaagcagaccgttgaagctcttgtaaagaacaagctggttgcatcctttttaccctcacatctgctgttgtcaccatcataattgttgatatgcctttaccctcaaaaggccagaagctctttgtgggcctacagaggaggcttctctgaatatttatccaatgactgagtctcatctgctttttagccccagagtggggggatctgactttctcctctatcagtagtccccactcagcatcaagtctattgccccagagggtggctttggctggatgggtctcagtttggtcagggtcctgggagaaacagatggtacattcaaacggaacacttgaagagagtataatgaaaaggctatttacaaggctctaggcaggctaggagaaaaaaaaaaaaacaaggaatggtaaacttttgcccaaagggataaagggaggaatggtttgcgtaactggtggaatgctattgctgtaggaaaggactggccaacaagacttgtggctgcaggtcaaggaactcagcagctgccaggccagagatcagtaggagggaacctgaagaataaatacccaaacatcaccttcctcctgtcctttcctctccttctgtaggcctttcatcactgcctcccaattggctgaaagcaaaaggaagccaaacggcaggaaagcctgattgatgtccccacagaggtccaacctcctgggccacagagcagaatggagaaggacaaagaatagagatggatgggagaatggggaagcatcctgcacagtcccttaggtcagagatgcccttattctctaaagataccctcaaagtttaagtggttcaaagaccagagttttggctacgggaaaatgtactgggtcgccttctttgacctcatcccatttcatttcttctttatctctatttctagcaaatttactcttctctgctctgagccatcagtgagattgtctatgagtatactagaaaaaacacagacctttctcacaggaaaagaagccatgtctcttcatggcagcatagcagaatagctaagcgcatgagtcttcgagctggattccccaattccaatccttgcaccattctagacagtggtactgggaacaagtaggtcatggctgattctgaagtcaaaattttagctgaagtttgttctggtagcagagcttcaggctcttttcatgtccgtggttcatatcaaaacagtaataataataataataatataatcagaaggaggagaagaagaaacatctactataaacaaacaatatattatcatacatggcatcactacataatttacatatgacacgaaggtatatcaattatgttcttttccaaatgctttcctctaataagcaaaattcataatctgactgcaattgaacaacaaaacagtctctgtgatgcccgcgtcatttcttaatactttcagtatttaattataatatgacgtcaagatttgggaacaagtcttcaagtgcctataactccagtctaaaaaagaacttaaagatgtatttttgaggattgccatctgtcaatttttttaaaaagtctgaatagtgatttcttattccattcttttttcttgtcaacagattattcttagtagttttctaattggacactgagaaaagagacttaagcatttatagagaagcgtgtcagaactcctgaattttgagcaggtaatttaaaagtgtaaaacaaacaaacaaaaaacaggaaaggaagagagtgacaaatgtcttactatccaggtgttacaaatccttagtttatcgatttgtaatatttacaaatgtccatgctctgaggcttctgtcttttcgttgaaataaacataaacagtagttaagtgatttgccacactgacacagagattggtgtctctgatttactgcaaagggcactacttcctcattacaggacactaatccctcttccccaaggatcggagcagacctagaatatactattagaccaagggacaacttcagccaaagcaaatcttagtgtgcccccctcagaccgtaatagcagctgcctccacaactcactagcttaaaattgctaaagggcaacactaagtaatctcagtgtatgagccagaatgccagaagaagtgccatatttgcttaaaaatagcaataccgatcatacttacatgcacatatctttagtgataacatttacctttatatttggtttgttaaaggtaataaagaatcctggcattcccttttgcttttgtccagatactttatttttgcctcttttgccatgctatagcattagataaagcaaaacgggtgtgcttccacctaaaacattctagggggaaaaatgttgagcagaaaaggattatttcaaaagaagccggatatggtggcatgcacctgtcatcgcaggcacttggaggctgaagtgggaggattgcttgagcccaggagttgggagaccagcctgggcaacacagtgagacccccatcccttaagaaataaattttaaaaaggggaccacatttaaactgtagaccgaagtggaatgaatcaatcggaaaggagagtggaaagcaaatgtttgaaagaaaataaaaagaaaagcaagccaacaaaataaatggacaaagaagggcagtgaaaatatcactaacagtttatcgtaagatgctctttggatgctaatctaaggtgttatgtgaagtttgcagaaaattcttgtgctaatgaaggctttcttcttcttttgagtatttccaagcttgaaataattgtgtgtagttaacttctatcatcatactgcaaactctaaaattagaattatttgaactgttcaggccctgtaacttttccaataaaatattctattagaaacaagttccttctagatcttcctaaaagaatactaaaggaccaaaccgtgcaacagcactggtggtattgtcttaatttagagagtccataccagtgattctcaaacattagtatgctcagagtttctggttcaataggtctgggccgggcccagggaattttcatttctaagaagttcgcaggtgatactgataactgctgttcccagggtctacattttgagatccgctgctatgtcacaaatccaaatccaaagtctttttaacaatcccttttagcccaggatgagcctaacggcaatttcacgtccttatcgccggccactttaatcttcaactgaggaggaagggagagtgagaattatgtatataatttttttcttttattttttaaaaagaaaactccaagcccacactcttaattatctgggatgaggtcatttgcacctgggtcatttatttagacaacaagtagtcttgctagaggctttaaggaggtgttagcagagcggtgtgtggcttccaggttcctgggtctaccttaaatccccatcctctttctttctttctttctttctttctttctcttttctttttcctttccgttttgaaagccccaactgcccagtctctgggtgtccgggttcccaggtccctaggtgggggcggagcccgacacggccccgccccgtctgcccgcagcgccccctccccggcccgcccgcgccggctcctccgcagtgctttcagctgtgagcttgggcggcggcggcggcggcgctccactttcggggagcccggcggctctgggaagctcactcctccactcgtacccacactcgaccgcggagcccttgcagccatgagggaacagctcaaagggtaagtggatcgcggccccggccccgtctgatggccgcaatccgtgcacttgtggcgcgagcagggggcaagctgaggcggtcaaaacttggacaggcgcggcggctggacccggggcgccgggcggctgggcgtctaggaacctctcccgcgggttcccgcggcgcggctgcaggtgcgcccccggggtttctccccaggcgccgggctagtgggggaacctcttccctcggctttgggacgggctcggagagaaaaagctgatttctccccgtccccagaggggataacgcgttcctcacgcggggattggggccgggggagcttttcactcctttccaggctgccagtgtggacgtgagcaaggctggctgttcctaaatcgtcgctcttactcgtagaaggaaggggcgcacgcggcgctaccttccattgcactgcaagtgccaaaaggtcaactttctgcctgatttcttccgaggattccaactgacatttccctcgctgcattttctaccgtgctcattccatgccccaagacctgcagaaatcaggaaagaaagaacaaacaactaaagcccagaagtcaaagatttcagggggtggggatttttgtttgtttgggcttttttttttttttttttttttttgcccttcgggattgggtgtggagtcatttctagggtgttctctcgcatttctccaggtgtctgtgctcatcttcaagcaaagtttgtcactcccaatcccagcacggcaataaaaagggcagaacactttgcttatattagtcaaatttgaagttaagtttgaagctttaaattgaaggggtttagttgctcgagggaggcataatattaattataaactgtttttacatcatgaaaaaaatccatccgatttaagtggtgaacttttaagtggcgtctttaagtgaaatctacatttttccttgggcaataaactcttcttggtcttctgctttatccctgtcatctctccttgtcacccaccccccccccccccacacccccaatcaacctttctttttttgcctagcttttttattgccttttactcaagcccctctttggaggatacatttgctgttggagaagcgagtggagcaaatgaagcaacacggttatatgaaaggtctctgacccttgaacaccgtggaattggtttcagtcatcattgtttgatctccgattggacacgaccctgaaaagaaattgctttgaccaaagttgagggtgggtaggagttaaaccttgaaaagcaaataaaacggaggacaactaacagctggaacagccaccgaggcaatcatctttgccctggctttagccagacagaataaaatggtaaatatcccagggaacaagaaatggggaactagaatggatttctgatgcttatattgatgcccacccctccaaacccctgccccacggtagcagaaactttaaaatatattttaccatccacaccctgccagtattccagcaatgcaagccaagttcaacaattcagcacgcaaatgccaaggttcctctagaaaaagagtctgatcctcagattaaagggaaatcatttgtgtgtgtggatcaatgggctccagattatatatgaaaccaaactctaatcctctgcaaatcgcaagagaacgctccctttttatattgctgcatagcgattagttttctccctgggaagtagtggacagatagttttttaaaaaggcaactgtttggaatattttcagtaccaaataacaatggtggcagaagaaatcttattttaattaggcaactgccattttcccagccacagcagtagatatttgttactttttataagtgtttaatgtttgtttttaagaaactaaaaaagcaattccaataagtctgattattccagcactgacagcaggaacagctctgaggcagttataataaccttgcacactacttgaaactaaagcaggtgagagaaaatttaaattgtatggtaggaaattaggtcagccttgtgctcagtagagtaatgctttaatttcttattattgacaagtaggtgttgctggggtcttttgtcatagtcgatgactttatattttaatttgcatcagggtcctatcaccgcctcaaataaaagggaaaaagattatcatggtttgtagaaagaagaaggagaggggaaatcttcgtataaatactgctcagagaggcatatctgatgccaggctttggaaccagcagggccaaaatcaataacattttttaaagatgtaaagagcgttttaaggattatttatgaagctgatctctgtgttaatgtacgtacagacttgtgatctatgttgaacattgttgttctcagaaaggccaaacaaagatgtacccattaacatgtgaacaggtttcagaatttcccttttggttgttcatggtatatggggagtgtatttccgatgtggagagtgaaatgcagaaaagagacaattaccaaaacagtgccacccacccttccactccctcctccctagcacaccgtgtttttctatatcgtctgcatattccaggtaaatgtgggctcttctcatggagttactgagaattctctactgttttagaaggcaggcacagagtaagaaacgaagctgtaaaatcggtattgatcacagacaaaaatgtggtttgtccttcaaggtacaagatagatatgagttatgcagatttgtgcttacagtttcatccagtccatattcatagttcctatctattttggagggttaaatgtgtcccagtggggctctggattcatcacaggtagaaaataacaagccgtgaagtgaatatttggttcgtcatatagttaccaaagaatctgaaggttttttggctacgttgccaagcatttttagcattaaatgattaaaagactatttttctcgttttaagaattagtcacaccctttattcttttcttctttccacttgtgctcacttcttttgcttagaactgatttgcaattgaagtgaaactaagactgcaaaggtgaaatctaaatctgtttttctagttcttttgcattgcttagaaataaaaggtttgtgtgttgaaggtgagaaaggttagcttctggaattgtttgaggagttcatttatctatgttattcaagtcccccagaatcacagataactgggagaatagtacctatcaaggactagtatcttaactcacaaatgggcaatggaattgggggcttagaatttcctccttcttccagtaaaggagattttcagttttgccgaggactgatggattaaaaaaaaataatttctaaaacccttttcataattttaaccttcaaaataaattctttaaaaaggcaggaatgtatgtatgccaacagtcatgaaatttctttagaagatggggagctccatgaagccctcattcattctatgtgggattctcctgtaaattgtacacactgtttccctttccttttagaactgtgtttggtacaggtttatttcttgcctatgttcctctaatttgaagtccattccagatggtggcttttcaccgtggttccctgtctctgtctgatcaggcttatcagctcagctaaatgtttttctgcagacctatagaagatgctacggtccttacaaatatcctggagatgggacattgttgttacacagtgtgactagtaagggcctgtgtgagcccttgtacatgtgggcacacatgtgtgtgcttcctctcttcgctcttcctttctccctggtgcttatatcacatctggatgacctttggaaatagaggaggcctgaatgcagggtggtctcaatagaaggtaacctttccttgctctgcacttatatatggaattggtatacactcactttccgagctgagaaatgcctgagaacaagcaacactttttccacgaagctgcaagctgcagcctccttgtgctgtgcatgtaaagtaccagtcctgcctaccccttctccagatcataaaccggcttggtcatggggtgtcctaaaaccccttaaagcatagagaccatatctcctgctcttcttgctctttaagacttgaatgtcactctgttatattccctcaactgataagcccttgttatagtcctcaaatgtgagttgtctctatggaaaagtaaaactgaaataaacgtatttggaagacagtgaaacagcacttcacaagtgaacattttcttgcaaattgatttcagtagccctcactgttcaatcactgactagtaaatattacagggatggtctttgaagttgtacagtttggatgatttccatatgtctttatgaggtttatgattgtgttccatttcttaaaccaacttaaacggttgttttaacttattttttttaaacataggtgataacatgtagtgtgttggttttgctctctaggaagggtctttcttcgccttgattgacttaattacagttggatccacatctatattgtaatcaactaataacagatttgcttttaatagatgacaatttgaggggcacatgataccaaaagcgaccacatattgagcaccaaatggtgccggtcacttacctatttcaactaatcctttaaccctccaaggtaggcaggcttgctttaaatttcaccgccagtagggcgcagagccctaaaattcaaaacatacgctaaggccattcgacattgttgcctctccagactcctctttctgtgtgaggcccctgtactttctggtcctctggaaatgccccagtttaagcgatttctcttttttccttccctccccttcccctcaaaagtttatgaataggctctgcatatgagtacccaaatatcattcagaactgcattttactgtatcaaagcctgtcatgcaatccctgaaaactggaaatatgacgctatggtgatttatgtagatgggccaaagtaaggaaaagtatatgtagttatttctccagggtttattcatgtaattgaatgaggaacaaaggtgttttgttctttttgtggcaggagctgatagccagcaaccacacttcaagaaatggaagacagctgtgaatgcttcattcaggcccaagtaaatataggaagaggtgtagtggtgtatagcgtactgcgtttaaagaaaaaacactctgaaataatgggaagaaggaagttatgatatattagtcaggcagtagatataccttaagctgaaatgaaatacaggtatcatggatatgagatctgtatatgtagaggaaagagtaatggaaaaatgtcaggggcagtgaaagcaaatgagaagtgagatgatttatatttattgaactaatgtccggtatctctttgacagagttgaataataatcagttgtcggtgtcctttctgtagtgttccacattggatgggtgaagaagtcctgatagtcgattattgatcacataacaaggtcaatttatcataactgaagtgcgatcgatttgtgggtgcaaagaagaaacaaattctggaaccgaataatgtttatattgcttttctctttggaaacaaagcagaaaggggcctttctgcttgtaagataaacatttcttcaatacactatggaagcgctttgaaataaagattccgaatggttcaaaagcaaaaatcatgttgttgttattgttgttttcttttttcctgttttcttgactactcattgtaaatgctaaagtctttctttatgttttgtgttttagccacgagactcaaacaacttgctgggaccatcccaaaatgacagagctctaccagtctttaggtaaggacatggccatgtttcctccaagttaaatgacaggtgacctttaggataaagtagtttgcagtgtgaaagttacttgctatataaatacatcactagattgtttcaagggtgaaagcagtggcaccttcctatccaaaattgacagtcagctttctttttatcagaggttccttaaaaacaagttttagaagttgattgattcctaaaaattcaatatacctgagagggcctataggtctttgtagttctctttggtgcctaaaatgatggaaaaacagttgcaatttatggctatttttttttttcttcccacgaagatagaaaactgtttcaggtgcttgttgatttcttccgtgtgaaaccaagacaacccttttgccaaaccacaaatgttgtgtaaaggaattttctgccgtctttccggtgctcacaattcctaaggcctggcgggtcattaatgtgaacatttaaatgatttctttagtatggcttgttttgtgtttatgtaagagcctgacagttctgttttctttcccctcataacttgaattattttgaatgggtacagagcatacaaataagggtttgaaaacaccagtctttttacactggacaaatgtccagatgtctggtttgtcgttttagatctacaaggaatattctgaaatgagttatcttaagttgcagcttgttttgggttttgttttgggacagggtcttgctctgtctcccaggctggagtgcagtggtgcggttatagcttattgcagcctcgaacccctgggctcatggcggttcttctgcctcagcctcctgagtagctgggacaacaggaatgcaccaccacacccagctcatttttaaaatttatttttatttatttttgtagagatgggtctcactatgttgcccaggctgtgtttttatgtatttttttaatataaaaacgtcatgtcttttctactttttcaagcctgcatttctgtgaatggacatattgatagaaaaacacataaggcgatctctttggatttaaggttatgtgatgaacactgtgggaatcagggtacttaaacataaattctgtgtaggtatacgtaagtggggtgtgtgtgtgtcagggggtacgtagctattactgcttttgtgtcatagattctcacaaaatgaattgcagctatagagacaccaaggactagagaagagatattagccaaaaaatggttttattaaacatttttctaattataaatgattaaatgtcttctagaaaacctgaaaaatgtaaataaaaaacatgaaaaaggaaaaacaaagtcacttatactagccagagagatccaatacatttcgagtaatattatgtcatttcagtctggttataagtgtgtaaacgtttaaaattttaaataaaattgggatcagctaattttcaagtgctacatttccagcccctacagaatgtttttggcttataattgtggactgtttataccacaggtggaaaacgtgaatgcttatcttttggcaaatgagagaatgaaaaggcttcatctgaagtgggcagcagctgtcctgggcaagctggtctttctatcccagtactcccaggacccctgattgtacaagagaaaaactagaaatctgtccacaaagagctaatttaaattagtctgtgggcctcctgatcgtaacctgtggtttacacagatttagcccacttctaacatttcctactctaattacagtaatttctagttgtaatattttaattcactcttattttaaaatcattattattatagaattaatacctattcatatttttgaagtttaaaaatatagacaggctaacaataaagaagagacaaatcattcgtaaccccacttcttagagttagctggtgtttaatagtctaggatcttcaaaaatgtctttctatacatatatttttatagaagttgaatcattctgtcttataacttgctttttttttttccactggaaagtaatgtattaccatggccatatttccattttgttgtatagtattctctaccactttcaattactctgtaatgagaaattgcaaacatgtttgatgaaaagctaattatggactatcaatgaatacatgtttgctcctttaatacaaattaaatatacatttaatcattatatttctaaaattttctccatactttagatgtggtgataaactcaaaactgataatctctcatgacttgtgacattgggcttgtgacatcactcaattttgaattataacagaattttacagttgcaggggattttagaactcatttattgcaaactttctcttttatgaaatcaactttcaggtataatttttatataataaaaggaagtcatcgtaagtgtgtgatcaattccagccccctttgaaattctgtttcttgctagcccaataacaaaccacttgcaagtgaactaagtgttgaagtttgcttttcacctttcagagttaatatttccaatagttttgtaacaatcaaacattcgttgggcttttatccaagtggtgattcatcagataacatctcccatttattgcgggcctattgtatgttttccacatgggatgtgccagcaaccaacctgcatggtggatggtatcaacatccacatttcacaggacagcgaagccaggctcagggaggaattgatcagggctacacagctatgtggggctacacctggatttgtcctcagttttctgttagtactttcactgttctcattgattttatttactaggtaaagtatatttatgttggttactacatacctgctacacgtatataggaattgatagttttacctatgaatagtaagttacttgagtggtatttctggaaatggtatggtgggtcctaaacaatgggcactcctttcactgttgcctggcacatatagaatgattgttatatggctacatccttttttgtttgtttgttttttgagacagattctcactctgtcacccaggctggaatgcagtggcacgatcttggctcacggcaacctccgcctccccaggatgaagtgattctcctgcttcagcctcccgagtagctgggattactaggcacccgccaccatacccagctaatttttgtatttttactagggacggggttttgccatgttggctaggctggtctcgaactcctgacctcaggtgatcctcccaccttggcctcccaaattgttaggattacaagcgtaagccacagcgcccagcctgcctacatccttgagatcccatataagattaactaccagcactgcctttccccctctccaaaattacagtgtttcagagtcgaaacataagcataaaatactgaaaagaaacttttcattgattttagtttttacttattagtttatatttttcttcttcaagaggtatccctttaggtccaaattgctctttgagctggatgaaatggtcggaagccttcaactacagtcagttggtgaaaggtatcttgaaagcagaaatggtgttgtggtctggcgtgtcaaatgtttaagaccacatctagccccctctcctaatcgaacctgaacctcatgtctctggtgaggtgctgaaaatatcaagatgttgctttttccctctgtacccccactccaggcatactctaccgtggaagctacagtggttcacagtatgcatggtaggttacacattcctagagacgcccacttctaaggagatttccattctctaatttgccaaagttcccaagcagcctgttcaacacatgtttatgttacctgccttgccctcaaaagcattcaggtgttcccctgcacccagggtttgaacacaataggattagaaggtgaaaacattttgttagaactgaaaaagtagcaagtatttactgatgaaaagctataatattgcttgagatattaccattggagctctctaatacattctgggtggttttctttttcattccttttccactgattttctacaatgaatttatattatttacagttagatgtttggtaaaaaagtttcttcgtcgatacccccattccatttcttacttagtgtctctatagctacaattcattaactaatgagaacttatgacagaaaagcagcagtagccacacacacacacacacacacacacacacacgccccacatatatgtagataatttatacttaaggaccctgattctcatggactttgtcaggtaactttaaactcaaagagatcatctcatgtatttttagtctgtatgtccagttgtgaaaaatgcagatgtagacattttagtggtagagaaaatagaacttttttgattaaaaaatagataaaaaacaatataagataattaattttagattatttccaacagatctaaaatggctttgcagaggaggtttccatcaagtgttagaaatattgtgtttccctcatttatcggctgtgtacctacacaaaaaattgagagaaaatattgccagagtcctacacaaacaaagcaagacatagtaaagaaataatttaaaggttcactatgatgactgaacagtcattaggaatttgagtccccagaaaattttttacatcacattaatggtttgacaaaagcattgtcttggattttcacagggaataaatcactaaaagcaactggaaatcagttttctttcagcatttgtctgtgactacccccaatagtcatagaatggtagtagagaatagtagtggagtaagtgggatataagagaccaagtgtctcatgtctattttttgtagaccttggtgctttatctttaaaatgtgaggatattggggctgggcacggtggctcacgcctgtaatcccagcactttgggaggtcgaggtgggcggatcacctgagtcaggagatcaagaccttcctggctaacatggtgaaaccccatctttactaaaaaaacaaaaaattagccaggtgtggtggcacatgcctgtaatcccagctactcaagaggccgaggctgaagaatcacttgaacccaggagtcggaggttgcaatgagctgagatcacgctgtagcactccctcctgggcaacaagagtgaaactccatctcaaaaaaaaaaaaaaaaaaaaaaagtaacgatattggacaagtgtctaagatttttgtttttcttttactttgggctgagggtggggcaggctgtttctaaacttgctgtgatcattatttttcaagaggtacctttcggctaactctgcagacaagtggatttctaaaaatgtaatcattcctatgttttaaaatgtacattctgagaaaacaaacaacaggagaagattatgccacccatccgtgtcttacaggctgagtgaggcaagctgttgtcaaatagagaggctcttgagatatttcccattagactcctctgggtcattcatttgttattgagagggtacattcttcgtcactccctagaagtaataatatgtttgattcatgaggtgagttttagatttctattagcatttttacaaatgtaatggaaagactgttccaataggttagcttggtgatttaaaactctgagctcttcaaggctccagaaagcatttacaacatcagtagatgttagatagtaatatgctctggaatttattttgaaatactaatataatattgatttacatgaagtgcaattatgtggttaaaagcctgtccttttctcacaatttatgtctaggtccctaagttcattactgaaattttaagaaaatattttttaaaaagctcaccctgcccccacacacataatatatgctgcttagagatacttttattggggtttttttttttttttttgacagcatcttgctctgtcacatagactggagtgcagtggcctgatcatggctcactgcagctttgaacacccaggctcaagtgaccctcccacctcagccttccaagtagctgggactatagccgtgtgccaccgtgtctggctaatctttttttaaattttttgtagagatggaggtcttaccatgttgcccagcctggtctcaaactcttgggctcaagcgatcctcccaccttggcctcccacagctctgagatcccaagggtgagccactgcacctggccttcacaatttccaatgtcaaatcttactacaaatttaagtaatcaagagtatttacatatggacagatatactgaccaacagagtagaatttaggctgggcacagtggctcacatttgtaatcctagcacttttggaggccgaggcgagcagctcacttgagctcaggagttcaagaccagcctgggcaacgtggtgaaaccccgtctccccatctctacaaaaaatacaaaaattagccgagcatggtggcatgtgcctgtagtcccagatactcaggaggctgaggtgggagggtcgcttgagcccgggaggacgagactgcagtgagccgaggttacatcactgcactccagcctgggcaacagaacgagaccctgtttaaaaacattatttcttagcctgtcttattgggggggggtctcttaattataaatacaataaaatatgtggttccccaatggttcctttttaaattacaatgtgagtttttttgcatttgtgatactgtcagtatagtacaagaagaccagtttatgaaggagacatgtaggtaaaaataggataatgtgaagagagaatcgctgcacttcagaaagctgattttatttcaagcagtttattaaaatctagatgcaccgtatgttctggtgttacttattccaatttccttttccttcattgaagccctcttaaccacaagtgttttctcaaggggtactggttttccttttcttaagttatagcgttcttcagaaggatctagccctttttaatctgttgcccaatttttggatcctactatccagcatgatgctcacctgaatgatgcgaaagctctcaattttcaaaaatggacttctgagtgtttttggaattcttaggaaaagtggtctttaaaaaccataagatttgaaggcagtctatcagcacgtagcccttagcttcatgtctatggtttgcagagagcttcagaatgttaaaatgagggtttaattttagggtctgctgggcctgaggttaggggtgtgattcttcagcagttctagttaggagaactagttaagtcctagttaagtcaatggggctaaaagctttttaaagatacatcaatatcattataaatcagcaatttgcaagagagttaaaaacactgctatcaaaatccttgtacctctttcctcagcttgcccaagaggaagggatattgtagttatttgttcactctcctcttttgataggctttctacattccattaagtattccctcctgaggatgctcttgggttagaaactgcaggattctgaatgactatgaattccttccttttgcattaggagcttgtcctaatgcttttctcagcatattttgtgaactaaactgttctccactaagctactcaatatttagctttccttggctcttgcttctagttccttaatatattgctcagtgttaaaacctctgccttttgactttttactgccataacgctttgaactggaaaggatagctagattcagatgccagctttggtgtgacctcgggcaagtcccttgctttctattggtcttcattttcttatatgtcatgttggccagtgatctttcatcattaaatgactggttttgttttaacccctggctagagtaaagcttggttgtatgaatgttgtcagccctaaacccccagttcctctttgtcaccaccaacctaaaggatatgaataataggataatcatatttattaatttaattttttttttttgagacggagtctcactctgtcgccaggctggagtgcagttgcacgatctcatctcactgcaacctccaccgcccgcgttcaagcgattctcctgcctcagcagcctcccgccaccatgctcagctaatttttgtatttttagtagagacggggtttcaccatgttggccaggatggtctcgatctcttgacctcatgatccacccgcctcggcctcccagagtgctgagattacaggcgtgagccaccgctcctagcctataatcatatttgtaataattgtactttatttgtgtagcactttacaatggcgaagagttttcagaaataaccatatttaatcctcacacagctatagagtaggtggcatatgacctggattttctatcaatttcagtttcagattttttgtcctgtcatccctttgagtgtccttccagtttttgatttgggaaataatgctaccataccggtggatggggcaacttttcccttctttccatttggacttgagcagactgagactcaagacttgatttgatttatactcactatggtagaagataaggaaccaagtccagaacacacattttacaaactccgagttctctgttctcaaaggaacatccattactcttagcatgatttataaaactgctttatcggcataattaaactggaatccatatgacattctttattccctagctgacaaaattagcacaggagatttactcaaatttgttattaaggctgttataaatgttcttcctttactattcagcttataaaagaaaaaagaaaaataatctgctcttttaactttgattaggatccattgactttccccatttgtaaaatagaaatgtaacttccaaatcaaaatttatggcattttaatggactgttctaaatattataatattttttcttgttcaaataacttgatttaaagcttctaattgaagaacataatagatatttctgaattgcatctctccaagcttatttcagaaggaaactcaaaaagaattgttccttagactttgactggtttacagttttaaaagagctgccaaattgtagtttactgatctaaataagaggaacattaaggttacacctgcagctagaagaaaagtgctggatatgtacaattttatgtagctggatctgcagaagatgatttttgcacacagagtaaaggcatctaaaaacgtgtctgctcttattcagacatttccaatatttcttttttaagcccacaagtctgattacctctgtatgtctcttgggagctgcaattttgctggaaagagattcagaacagtcagagcactcacataaaatagatagtttttaaagtctgtaccctctacggtagtaataaaatgacctaaaaatattctgaaagtctctcttatgacatagtggatgaatcattagcttatttatgaattggtgatattctgtgggaatgtttcaaaatttgctattccacaaagcgttcatcgcttgcataactccaggaaagtcattacaccccctcataaatagaagcttatataacggagacaaatgttgcttatattgatatatttacatacagatttctttaccaagcattaattttggtaagaaagtgattgtttttatattttactttcttggtctgtaaagaggctatcactttaaggccaggcatggtggcacgcacctgtagtcccagcgcttccagaggctgaggcagaaggatcccttgagcccaggaatttgagtccagcctgggcaatatagcaagacgttgtcttagaaaaaaaaaaaaagaagctatcactgaagagcagtgcttctcaaactggtgaagggccaggtttttgttggtggtgggtttttttttttgtttttttgagacagagtcttgctctgttgccaggctggagtgcagtggtgcgattttagctcactgcaaactctgcctcccgggttcaagcgattttcctgcctcagcctcccgagtagctgggattacaggtgtgcaccaccacacccagctaatttttgcatttttagtagagacggggtttcaccatgttggctaggatggtctcgatctcttgacctcatgatctgccagcctccgcctcccaaactgctgggattacaggcgtgaaccactgcacccagccgcggtggtggtttttaacatactacacatcacagatttttaggtggtgctaatgaaactgacaagtatgcattcacaccacatgtaactcaacagtcaagttcaacaacacttgacctcgtctgtaccctgctccatgagatgaattcattgatcatgaatttggatgtcatggcaatgtcaaattgctatagaagttacttaacacactgtccatatctatgcttgtgaaagaccatattttgagtagcactgttctagagcacttaatttttgaaagtataaatgtaaactcaaatcaagtgactcaggtcgggggaggataattaaccaaacaggaacacctgaaaatgttatttatgcggtttaatgttttgccagttgagtcaagttcaggcagaggagggatctattttctttcccacttggtagctctccttagcaattgttttagaagacaaagcatagaaatcattgtgttacaggaaggaaccagagattaagcggcagagccactgctgcctagtttaatgtctctcgcaccccctataattaaatataatgtatataatgtgataagtttaaaatacaggtttgcttttatctagaatataaactgtgatatatgcactctttatggggtgcattcagtgggggaactaattgattatactgtgactttcctattgtcactttatgagtttaggtttggaggcaatgttttgcagcaacaaaattgttcattgactttgaggctggatttaaattctgattctgtcaccagttctctgtggtcaaaaaggaagccactaataattttaaacctcagttatgtgatgtattaaatagttatgatgagacttatcttgtgttgtgaggattagaatgacatatgtaaggtaacagaatgtctgatgtagtaactgctcaaggaattataattgctattagtgatatgcattattattattagttattattatcatataccagtgtctctccttatttaataatctattgggttcctgaattgagataccaagaattcagatagtgagagacacctaggtttaggtcttcacatttgacactcaaggagccactaaatttttctgaagtattttacttcttaaccaaggtgataaagatcacctgatcacaatttatcctaacttttggaaagcatacacgtactttaatttgacatgcaaattaaaataatacattttgtactgtgttgtttgccctcccccaattctaaaataatatatcattcaggataaaaaagactacactttgggaggccgaggcaggtggatcacctgaggtcaggagttcgagaccagcctgggcaacacggtgaaaccccatctctactaaaataaaaatttaaaaaagccagaagtggtggcgtctgcctgtagtaccagatactcgggaagctgaggcaggagaattgcttgaacctgggaggcacgggttgcagtgagccaagatcgcaccactgcacttcagcctgggcaacagagtgagactctgtctcaaaaaagagcataaatatctaataaatgatggtggtactagtctgtggtagtggaggtatcacagaatggctgtagagatgaggagggctaaaactgtgaaaagccttatatggtatgttgaaggttttttatactaaggtttttgatttggaagatgtatcaatcagggtctgcctggtcagaaaacataaaccctctagttatttcaaacaaagggaatttaatgcgggaaattggttactcaagaatggaagtgctgagaagccacacacacagcatgaagtttctgttatacctagggctggagggacaatgacaagaggtggtatcaccagagccccagatgtcatgggcatcaaggcggagttggaacctttggccagctgggaccaatgagggaggggctccgagggagctggagccaggaaggagacacagttagccagacctattgccggaggtagaatgaaaaaggaagtacgcccggcttctcctttccgcctgccctctaggcttctgccagtgactcctattggccaaacttacttggaagccaattggtaagggagcaggaaaatgtactgtaataaacagcagagcagagaaaaggcagagaaagtatcaaaaaccaacaagcaaatgattgaagtacaggagatcccatggacagtaaggcaaccaaccctctatgcagatatttcgggaacaagaaacataaaaaaactaaaaagctttcataggagtttgaggtgacatagataagataccagaaggacatcctgggttcaaaggaaactgatcttaaaggagaggaggtagcaattaaaacaaattatctgcagagaagtccaaacactaaggataagcttccatgcatttgatgaaagtacttgcgacgtttacaggtgtttatgctcatgactctcaagactaaatacagacataccttggagattttgcaggttcagttccagaacacttcagtaaagcaaatatcacaataaagtaagtcacacaagtgttttggttttctagtacatataagttatgtttactctataatgtagtctagtaagtgtgcaacagcattatgtcttaaaaaacaatgtacataccttaatttaaaatactttattgttaaaaaagctaacgatcacctgagccttcagccagtaatgatccttttgctggtggagggtcttgcctcgatgttgatggctgcacagcatggtggttgctgaaggttggggtggctgtggcaatttcttaaaataagacaacaatgaagactgccactcagttgactcttccttttgtgaaagatttctctgtagaatgtgatactatctcatgaaaccacttactttgctcatccataagtagcaactccctatccattaaagtttgatcatgaaattgcagcaattcagccatatcttcacgccccacttgtgatttcaattttcttcctgtttccactacatctgcagttacatcctccactgaagtcttgaacccctgacagtcatccatgagggttggaatcaacgtcttccaaactcctggtaatgttgatattttgacgacctcctatcaatcacaaatgttcttaatggcatcaagaatcacttccagagattttttttttttttttttttgagacacagtcttgctatgttgtccaggctggagtgcagtggcgtgatctaggctcactgcaacctctgccttcctgggttcaagtgattcttctgcctcagcttcccgagtagctgggactacaggcgtgtgccactacgcccggctaatttttgtatttttagtagagacggggtttcaccattttggccaggctggtctcaaactcctgacctcatgatccacctgcctcggcctcccaaagtgctgggattacagccgtgagccaccacacctgacttccagagattttccatttactttgcccagatccatcagaggaatcactgtctatgtcaagctatagccttacaaaatatttctcaactaataagagttgaaagtcacaattttttcttaatccttgggctacagaatggatgttgtgtaagcgggcatgaaaacgtgaatctctttgtacatctccatccaagcttttgggtgacaaggtgcattgtcagtgagcagttatattttgaaaggaaacctattttgaacactaggtcttacagtgagcttgaaatattcagtaaaccatgccgtaaacagatacgctgtcatccaagctttgtttttccatttatacagcacaggcaaagtagatttcacataattccttttttttttttccttccaagacggagtcttgctctgtcacccaggctggagtgcagtggtacgatcttggctcactgcaacctccacctcccgggttcaagcaattctcctgcctcagcctcctgagtagctgggattacaggcgtctgccaccacacctggttaatttttgtatttttagtggagacggggtttcaccatgttggccaggctggtctccaactcctgacctcgtgatctgcccgcctcagcctcccaaagtgctgggattacaggcatgagccactgtgcccggcctgatttcacataattcttaagggccctgtgatttcagaatggtagatgagcattggcttcaacttagtcaccagctgcattaggccctactaagagatacagcctgtccattgaagctttgaaggcagtcattgatttctcctctagagctatgaaagtcctagatagtatcacctttaaatagaaggctgtttcatctatgttgaaaatctgttgttcgttgtagccaccttcatccatgaccttagcttcatctggaaaacttggctgcagcttctgcatcaatgcttgctgcttcatcttgcaccttaatgttatggatatggcttgtttccttaagcttcttgaagcaacctctactagcttccaacttttcttctgcagcttcctcatctcttttagccttcatagaattgaagggagttaaggttttgctctggattaggctttggcttaaagaaatgttgtggctagtttgatcttctattcagagcactcaaactttctccatatcaggaataaggctgttttactttcttatcatttgtgtgctcgcagggtagtacttttaatttccttcattaacttttcctttgcattcacaacttgactgtttggcatgagaggcctagctttcagtctgtctcatctttcaacatgctttcctcactaagctcaatcattaatagcttctgatgtaaagtgacagaggtatggctctttcttcccttgaacacttagaggccattgtagggttattaattaccctgattttaatattgttgtgtctcagaacaggaaggccagaggagagggaaagagatgggggaacagctggtcggtggagcagtcagaacacgtatgacgttgatcaattaagtttgccatcttatgtgggtgtggttagttgcaccccaaaacaatttcagtagtaacatcaacgattactgatcacgattcaccataatagatataaaaataatgacaaatttgaaatattgagggaattttcaaaacgagacacagacccaaagtgagcacatgctgctggaaaaatgtccatagacatgctcaacacaggattgccacaaaccttcagtttgtaaacaatgcaattttcacaaagtgcaatacagcaaagtgcaatttaatgagatgagcctgtaatgagcctctttaaagcaggaactgtcttcctcatctttgtcaccagtgcctggtgcatggtagcctctgaaaaaataattgttcattgaatgaagcacagtagagcaagggagagtgattttgctcgggaggaaaacaaataccactcaagaagatggaaagatacagatgagggttttctaaggcggattattaaactggcaagatggaactctggagagatggagttctttccagaaagtagaagataaagcctcaaagtaattaaaatagggaatatcagttaagttgtagattttattggcaatttgttatcttagcaaaaccaagtgaactgctattctggaattaattttgccctaaaaggaataattaattgataaggagaaataagacccgtaaaaagtgtcactatggattcagaatttatatgacaaagaaaggaaacactgaacacaatttgatgtgctgatggcctcgttcgttcattggtttcctgcttcagtaaacatttaagagcgtgccatgtattttcaaactttagggcaacaggctaaaaatatcaaggagaaaaacgtttactgagggtatagaagtttttatgatcttacttttattgaacattaaaacatggatgttcattctagaaattttagaaggtgaagtgcaaaaacaaaatgaaaatcacctcacatctcagtacccagaaatagccactatttacattttaaaagattgcttccggtcttctttcctatgcatttttatatagttgtttgagataatagaatgtttaaagtgttgtatcctactgtaatcataagtcttctcttattcttagttcctcagagatgttatttttcgctagttgcagtttattggggtaccacttttgtaaaaaaatatttcccaatttttgaaaattgtgacaaagaaaagtcaaattcgtgttgaatttatggaaggaaatctttaagaatctggaggcttattactaacaagcttctgagaagaaagccaagtaaagtgttataataccttctgtccaacaagctacttatgtataagtgatgttacagaataaagtcagtgtggtcaaaaacagacagtcagttatcagaaagttgataagtaacatttatcctatgaaaaatatagctatgaatttaaatcaatagttttctaccacaaatatcttaatggataaaattttctttaccaaatatgtatggtgtcaaggtgacaaggcaagtatccttgtaaactttccgaattacaggaacaactttgcccttcttagcaagcaattttatacagaaactcaactttatgatgggtttctgtaagttttaatttttataataactgatatgtaaatatttagttacctttaacttatctctccaggtagaatggctagcagactgttttatcttctcaaaacatttgtgtgtacagttcccatgttcttttcaaggttcttgcttctaactgtcagttaaggcttttgtagcctcttacttcagttacattttctggccaagacgcaattaaagaatatagagctgataattatttccatagtcgtttccaatttttctactgttccacgtaagactttgaggaacacctttatgcataacacctttctacatttgattcatgtaagtggaatcactgagtcaaatggtgttaatgtttctaagcttcttggaatgcactgcctgaaactttctcaaaaggctgtagccatttacactcataatacttcaaagtgccaatctaaccatgtccttcccagcatggagtattatttttacttttgctattgtaacaaggaaaattaaaccatctcattgttaatatttgtgtattttttatttctagtgaccacaaatgttttcttttaaatatctgctgggtgtttttcttcttttttgagtaatgtgaaaacaaaacgaagttaaccaaacacaactcttccaaacttttctgatataatacacacttttttgtgtgttatgttgaggggctctagttggtaacagcctcctggttacataaatactgtacagtttaattttttttcagctaaataagccttatccctttatccatccttagtggatctattatctacccattaaattaaattttattctctataccaactcctgtttcttcacattttttaaatatatgcagagccctaaattacagtggctgtcctaataaaaggctattcagttattaacagaaaaggaagattgcttcctgcctcttgggtgaggaagactcatgtataccatagatatggtcagtttacatttacagttttctgtgaggcattgatttttttcccccataaatatggagtacttagaatgttcaaaacctttctctgggtaatagaatgcacaaaagtataaggcatgatccctgttcattgcccaagctggcgtgactctggtcatgcagcggacttcatgatgtgatagaattccttgcctatgagagtgaaggagatggtaccaggtctacttgtggccggtggtggaacacttacattattctaagtcctttctgtctgtagaacccaaatgacaaccatattattttatcttctcttattgctagtggtatcgtttattaatgccaacgtatacccattttgcttttcaaggttactttagatgtcttaggttggaatgactgaaggcttatacattcaaatttatatatgacacacacacacacacacacacacacacacacacatatcttattgttgcctgctatctttctacctgttgtataagaaatcctttgaaaaaagcctatgtcagcttcacaaaagatgttactgtgttttgggggaaataaaattgggaagtaataaaacagttaataaatgttacaagaccgtgtacaccaacttaaataagattaaggtcaaacgtatggtaccttatataggtaggaagagcagtattaattagaataattagggagagttgtttggagagtggaaaaaaacattgttctaggaagaaattttgtaatactcaggtaaagtaaaatgtagggccaagatattccagatagtgtagcagcataaacaaaggtatgaaagactggcttgtttgcgagtcagtgaagacattgttctctgagaatctactccagatttttttttttttttttttttttttttttgctttttgagacagggtctcactttgtcgcccaggctggggtgcagtggtgcgaacatggctcactggtgccacaacctcctgggctcaagtgattctcctgcctcagccccccaggcagctgggactacaggcacacaccgccatacctggctaatttttgtatttttggtagagacagggttttgccatgttatccaggctgttctcaactcttgagctcaagccatctgcccatctcggcttcctaaagtgctgggattacaagaatgagccaccgcgcctggccactccagatttttaaaagggaaatctgattcagtgcccctggggtgaactaagtgccttaaattatagagtgagaaatttacattgcatttgattggcaatgggaaaaacattgttaaatcttcagaaaagagaaataatgaagtccgtcttctgtgttttggaataggaatttggtgggtgagtttaaggacagttagagaggggagagattatttcgttttgttttgaggtaattgacatgatgagggtcttaggatagcaatgggggaaggaaaagggaacgtgactccagaggtttttcttaacaaggtagaattgccagaaggtaatcacagattggacaggttttaaagaaaaagggagttatatgtcttcaaaatttgaaggcgtggtgacacagagaatggtgataccattgaggaaaagaggaaattgcaaactgagcggagcaacagggaatagatatgaatttgattgaattacatacttatgggtttatttacaatttctcttcttagaaaaatttatttttggtggctcatataaatgtatgtgctgccataccataagcatatatttctcattaatcctttcaaaaaccctgtaaaagatatttgtatctccattgtgcagatgaggctcagagaaaataggtaattttctcacattgcaaagcagggatttacgtgtacttttaactcctaaaccagcgatttagcccctcagctatactttcttcctgagaggggacagtggcattttgaagaggaaatactctaaagccatttgaaaaggggaaccgaagaaagagtttggtccacagcatgataaaaatattacttgcacttttattatactttataacaagaagtacaggggcagagaaaggttcctaacttttactgagcaagtatatatccaagatacatctcctctttggagcttttgagatacactatctctcttagttttgcaacagccctaggaataggtactattactgttccctttaaaaatgaacaaaaaaaaaatgaagcttaggaaagttaaggttactagaccaagcttattgggagaccatagtgatgaagaggaagggctttagggtcaaatggatttgaattttacttcttaggcctttggtttccttatttataaaatgggattgaaataatgatatcacagttgaaggtaattatatgagaatttatgttatttattgcaaacatagggtaagcacctaataaatgataacctgagaatttatgttatttattgcaaacatagggtaagcacctaataaatgataaccattattactattattttacagcaaagacataaatagagcccattaagttttcttctctacccagtagtttttccattgtacaatagtactctcctgaaggacagcgggtgaagctaagaatttggaagaaatcccagatagagaaatcttgaaaagaagatagatagatttaatactcaatcattaaaaaaagtgcacatgactttaagaaatcaaacattgtaagaggatagtattgaaaagtaagtctccaaccactcttggtatcaatcccctaattttacttcctagagacaattaacagtatagtttttatgtttgcttctgtaaatatttttgcatatacaaacatacacataaaaatatgcccatttttgcacattgagagtataataggcacaatgttctgttctttgatgctattaccttttacataattaacctggagttttttttttcctgtagcgcaatagactgacagatggtgaatgaaaacttgcactatggagagttatgtcagtgttttaataagacaggaacccagaaataaatgtacgaagtttaacatcagcatctcgtggcctttaagtcaaattggacaaccattcaaagcttcataaatgctaactgcttctcatgacttcagaagcaaacaaaaaaatcattattcaaatgggaaattaagctgatcatcagaagtacagagaggatgtcctttcttaaaggcggcacgtctaagggagtgtctgagacctggcttcttcattcaggatggaggctgctgctactctttaaaagaaatgttcacatccttacttcctgacttccttctataacacagtctgcttcacaacactatgactttatatgtcagagcgggttaggaggagctgaatcttaaaaatttaagaagatgccaaggtctagaaaccactcttaacaggggaaaattagaccctgcttgcttttgggaaaatttgttttccagtcagatgtttgtcaaggttaaagaaattcacgggccctctgttcgaattgggagcaattgggagcccttaagctgaatgagtagacttgaagtcccacttagaatgagcctttatatttttgttctgtggcttgctcagggaagggatacacacttggggagaaaaagacttggattctagttgatgtttttctcctagctgactagggaattcagaacaagttactaagagctttctagtccttagttctctcatttggaaaatgaaaattttaaattagagattctatttctaaggcaccatgtatttcattttcttaataaaaagtatatatattcccctaaagaatactcataagaaaaaggtagagttaaaatttcccaaattatttaattcctggttgcccagtaaccattaaatttctcagcagtcaggcaagaaccacattcccaccttgagacaagatttaggcctttccaaacttaccctcgggctctgttccaagtttatttgtaagtcagttgcatacaatttggaatgaaatgtgttataaatggtggttaggtccctaagtcacagaatcttagttaaccctcagagtgcctgatatactgcaccatgtaaatagaaagcagctgtatgtttctatgggagcaaaaaacttttgtaggaaaaatggtagaaactcgtactgcaggtgttgattattcagcaaacttctctagataaggaggactgggaacttcatcattattggtctagttacattcctggtcactccctcatcccattgactggtcagtttccctccctgtggtccttgtgcaagggtttctgcctcaccccataccctctgctccttgcccggtatcatggttcttctgagggtactactgcccattcacccttgtgctaattaggattacactgggtaaggaaagacatttgttctgtagcggagaagcggggaaggccatcagaggctttgagtgtcagaaagatttggtcttgaatgcaggctctgggatgcaaccgtagggaagttaccaaacatttgtgagcctcattttatctttaacaaagctgataatacagaactcagggccttgtaaggactcgatggtatcaggtacacacgacatttgcccttgagtgctcagcgaatgttagtattccttctgccatcggcctgtcacttccgtttttctctttggctctacagggaatacttgcatacaaaaagagctgaagtaagagtcacctacatcttaggaaaaaagggctgctttaggtttatcctcaagtagttttgtccaggattctgaggagaataaaagctgggtcagatccagtgtgttgaaaagaaagctgaggtgagaagtgagagaaacagagaggcagagaaagggggaatgagccctgtctgctatgaagtaggaggcaatccaaaagacaaggaatccgtggtcattgccactgagaggagaaagaaggcaaactcactcctgtgacttcagggccatccatgaggtgggcagaggaactcagagtctgcccgattcttggattgaatcttcaaattggtaaagctttatatcaagcaactcccaaatgcagcatagttttgaggtgataaagaagagtcttttcaaggctgggcacaatagttcacgcctgtaatctcagcactttgggaggccaaggcaggcagatcacttgaggtcgggagttcgagaccagcctggccagcatggtgaaacctcatctctactaaaaatatgaaaattagctgggcgtggtggtgggcacctgtaataccagctacttgggaggctgaggcacaagcatcacttgaacccaggaggcagaggttgcagtgagccgagatcatgccactgcattccagcctgggcgagagaatgagactccgtctaaaaaaaataaaaataaaataaaaagagtattttcccggagtaccggtaatattggttccagattcaaatgtattgtccagatacacagagggtaaacaggaacgcttcaggcatcctttattaaaagcacctcagtctatgtcagagggccaggcagtccattatctaatgaaaatctcctaccattgatttattttatcataactgcagctgctaagtaattttgtttaaggaatgatttacatattagtgtcttcagcaggatctcatcattagcatctagtctccagaaaagttaacacataacagtgaaaagaaaacattctctatcacatgcttctgcatgcatgggcaatttgagtcataccacctgttcccctcttctgttatgctagagtatacaaaaagcagagatacgcatagtttactatgatcctagatgcttaaatatcttgaattgtgttctatcttggactcattattcatgcataaagactcaacagattctcttcttgcacctctcaaacagcaacatcaacaaaacccaaacaatgtatctttcctaatgaggtgaaagcatgcataccagcctaagacagaaatgttgcaaaaatgttttttgcaagaaggtcagtttgcttttcccatggtaactaaggttaatttctactgtggttcattttggcatccattttattcatgatgattattagagggcatggatattgggggtgtgttgatgttgggcaccagagaaatggaaagaggcagatggaggatgcaaatcattttcactcagaacctaaaatgtttactgttagataaagggtagagaagaatcttaatttgactgtcaaaacatatgattagttgaagttaccaaaactatttttttaaataacatttatcttaagagctataaataaagaggaaattttgcactagagatgaagttatgaacatttcattaactctaaagagttaatgaaaaactagttgattatatgtgttcatttataggttgacacgtgaatttccagagaagtaacttgtatgtttttaaattccaatccttatcttacatctgggcagaatcagacttgtgaacgtcccattccaaacaaatggctaaacactttgcagactttgtctagaagagtgccttacccatataagccctctgttataaaattgttttaaacgttaaattagctgtcaagctgttctgcatcagtggcaccacctggtagcaaggatggagatctctgccacccaagatctctttagtgctcacgtcatttctccaccgcaaggaggattgcgggggtggacgatgctccctatttagtcttctgcattttgttgcttacagttcaattaacatgtcagttagagatgacttttggttgcagttaataaaatatctgaccaattgtatcttaaacacagaggagttgatattttttgtagaacaagaagtctggaggcaggtagttgagagctatggaagagttccgtgatgtcatcagagacctgggccatggtttattctgctgtaccatttttaacgagtgactttggtcctgatggttccaagacgactgctgcttctcaggcaggaagaaagagaaaggacgttcagcctcagagtctctttgtctttccatttgggaagggaaatcctttcttgcagatatcttctcaagcattggccaaaactgtgtccacacagcttcccctggctggatcagggaattgagatcctccagcctttgtagcagagaaagaccaaggagaaagaatttgggaaggggtgttgagtgagccaacatacagttatctgccacaattaaatacagcggattcaccttgcaaataagcattctttttagaccatttattttctttctctctttgtcccaattcctttattccttaggaaagtcttgatatctttgtgaggtgtgtttcaaaaaagaagctccagctcaggttgtaaggagtaagcaaaaataataattccagtgattcagccatagaagtggaaaattatattatttgaagaaaaattagatgtaaaatcaatgtcatcgacagcttaaacctggtaaaagcaaggaagttcctttcagaatctaattttattccaaatacatttattgagcaccatcatttattgccctagatgccaaggataagtgaacacaacatgacctcttcagaagtctgcatttttctcatcttttttccctcaagtataagaatgaaaaataaagctatttctaattagttacatcagtcatttctatcagtattactatagattttatttttattgtatactggatatttaaactaaatttaagcctttgtgggcttagaaattactgtttcatgagtaacatggcttatgtaggaaatttccaatgccattaaccttaaaaatgttcattggaatactgcttatgtcatcttggaaactacctttgcggttgacatataaactgcacgatggtctattttcattatatgtttctgtatgtacataagcatcctcatgataaagattgtctacttgatcaaacttcagccagactcctgaaccttctcctaggcccacctgtgcacttctttgtaaaaatccagctgtagcgagaatcctgctaaatcagtttagcaagaaccaccttcctcttatgtatctgatcaggttcctcatcctccaccatcccccatgtgacgtctgatcaccctggcctgtgtcttcagcaaggttcctgttaagttttttttagctagaatcccccttacccccatgctttctcttagtagttttccatccaccaaaccccaccctgctccttggctatcaattcccacttgtccatgctgtattcagagttgagcccagttctatactgaggtctctttcccactattgcaatattcctgaataaaatctgtttttaccactttaccgtccatctctggtttttctttgacactcacataaccagagttttgtatgtgtgtgttgcttgacacatcacaaatacctgggatacgtgtactgattttttacagggtgaataatctttttgttttccccaatatcttagaaacctgaatctttaacccctgggcttagtacacagttaggcatataataggtgcttaagtaagcgtcaactgatgattttaaatgcagaagtaattgtcacttaatgaaatatagtcaggagactcatggattttggcctgtcttcctacctgttcttgtactgcaacagtaagtgtattaaggcaatatttttggcagcacaatcatttagtttgaatgcattagtaaaaggtggagtccaaagaattaatcgctggaaagttttgggaaaacccagtaacaactgtttccatagagtaatttgagtgacagccaggtaatagctacttattggagggactccacagtcagagccttgacagggacctgaaaaagagtgtaactgaagggtaaatgtaaaagcttttgggagaacaagggagtggtcaggctgaggcaaagatctgaaaagaaatgcctcctggggccaagctggtaatttgaatgactgaaggtgactgggtgggaactggggcaacctgaaaagcttctgttagggtaacagagcctccgttgcagctgactgttctatgagaatgtgagtctctattgtcaggtcttcaggttcttccagagaagcaagacaacgggaaatcaccagatttttaactaatggcgtatcattcaacaatttcaaaaaccattatgtgagcccaaactgaccaacgaatcaaacacacacacacacaaaaaaagagtctgcagactaaattcaaccagttggtgacctctggtctgtggttaccagagaagtaattgaaatggagttttgggagaaagatcatatgttgaaatcttgggagataagggcagagaaataagtaagccgagacggcggtaaggccaaggtagaaaaggtagcctttaggaaaattaagttaagactttttaaaacaggaaggggcaaaagatgaggttaaagcagatgaggaaatttactgttatttattttcatcattaaaatacgctttccacaaatttttcaactgtaagagagagtgataaattcaaaataggtaatgtcaaccatattatgaagagtatgtttttgcaatccaaaaaagctaaggcacaacattaaaaaaaaaaatctgtgaatttggctttgcaaaggtataagaattaagtcacatctgatcatttttagagtcttaccttttataacaaagaggaaaatttaattaaactggctctgccctggcgaatctgggatgtgtgttcacttatgaagagagactgttaagattcgttaattaatgaggttgagaatagagttgaaggagattggggtaaatttataagtttgtgtcattctgagagttctgtaagtagctgagttacccatgttgtgactgagaaaaacaggagagagcagtgactgaaggttctgagccaaaggaggagaatagtattgtttattccagcagccagagtggcctgtgtgactgtaagtcgcctgtcaagagggagactgcaaggaaagtgcattgatttgatttggagtagttgtaactgcagcatgaagaatatgatatatagggatgataattgaggaacaatttaatggctgcataccttgctgaagttgaagttccttctggagataaaggtggcaaaaaagaaagtgcttaggtagaagagctttttaaaatgagttaacagaaaacagcagactaaatatggaattgaggagtaggaaatgaaggaaatgaatttgaagatttactttctttcaggatgcagagctggtatgtaatccctctgtttccagtgccttctcccacttccaaatttcactgctcctcatgcgccctggtgtgtggtgcagcttcgagattaagcctccagccttctgtcaggatgaagcagcaggtggctgagatgctaggctccaagtgggggaggtgtttagggctctaaagactttcaaccagtccttgtattttcagccacatttcagtcttcagaggaacctggagcctttcatttctgagacttcttggctacataaactggcatgcgtcttgttagttcctcccactccctgccccaatctccttgtctccccaacatcattaattgagcttgggatttctctggtctcctaagttggttaccagcaggtcattttctaagccaccaaaatactggagctctgatctgttctcatctcctctcctgttttgttaattttcttttgggtaaatgccattttttattcctcttctatcaacctggtagagtttcagggataaagagagacaaatgagtctgctccatctgctgtgtttaactagaagtcccaacacccaaaatccttcacacgatgtgcagggctctgcagtgggcctccccctgcctacctgtcaggccttatctgtgcccactcttcctccttcctctctgagatttcagcaatattggccttctaaggattcttaaagccccaccttcttctctgcttcagagcttttttttttttttttttttttttttaacatgtgctgacctattacgctgctgtgttcttacctggcacgctcccatcatccttcaagtctttgcttcaatgtcaccttctccaagaagcctctcggacctatgtttccctatgtatacagtctcatcacttcctgtgtgtttccttcaccattttaccacagtacatatgaatatttgtttgttagtttgtttgagacggagttttgctcttgttgcccaggctggagtgcaacggcacaatctcggctcactgcagcctccacctcccaggttcaagcgattctcctgcctcagcctcccaggtagtagctgggattacaggtgcctgccgccgcatccagctaattttttgtatttttagtagagacggggtttcgccatgttggcccaggtggtctcgaacttctgacctcaggtgatctgcctgccttggcctcccaaaggctgggattacaggcgcgagccaccgcacctggcctacatatgaatatttgattattatccatctccttcgctacactgcaaagtcaataaaggcagagatttattttggttaccagtgtattccatgtacttggcatggttcttggcttatagtacatgcacaataaatattgaaaggatagatgaaaggattatggatagatgaatgtcttttaagcagttataaaacagttctgcctaaagagtcttttttaatcagtagtattacttcaaatacatatttaaatacacatatgttataaatatataaaatatgtatttaaatatgtcatttgtactattttaaatgtatttaaaataatatatgttatatattaaaataatactaatgatttttaaaagatcaggcaacactgctttgtagctttttagaagacatttatccttatggatccataattattatggattgtatgttttatatataatgaaggttttgggagttagagccctgatccttccgctcttgaagcttgatttaaaggagcatggcacagtggtgcctatatgagtcagccctccattatctggggcagaattcaggccccagaaatggtacttaagatacacagttctcccccagaaaactttatatcggccatttgttacagaaactgctttctcaacaaaccttttaccagggcagctaacaatgagcaaaactaatttgaatttcaactctgccattattacagtgttgctaagaagtagtgagattctgctgaggaaggccaagcaagaggagggagccagaaatgccttaaacaatccacagccaggattttgtgctatcttttatttcacagttgaacttctcagtattttttggttcataacctttttctcttttcctcaattctgagtcttccacatttgtgccatactaggtactttattgcttctctcccttttttttttttcttgagatggagtctcattctgtcgcccaggctgaagtgcagtggtgcgatctcagctcactacaacctccacctcctgggttcaagcaattatcctgcttcagcctcctgagtagctaggattacaggtgtgcaccaccatgcctggctaatttttttgtgtttttaatagagacggggtttcaccatgttggccaggctgctctcgaactcctgacctcgtgatccgcccgcctcgacctccataagtgctgggattacaggtgtgagccaccacacctggccctctccttcatttcttagaagagttttacaaagtcattggtgataaataagtaataccatttcacatctggaaacataacttgatagtaattataaattcacagactgtactttctgtacttatctaagtatgaatgcataattcctgtttatctgtgtgtaggtttatttttcccccatttaagtaaagctctatgttgatgatgaggtttttacgagttgagattttaagaggcctcaaatatatctaaaaaattatagaccaagtatgatgtgttagtgttcctcttctctcagctaattctttaaagatatgttccagaattcctggtctgttcttgaagatctcccaataattctagacttctgaagcctggatattttggcttaatttgctttcaagacagactggatttaaattactcaatttgtctgaagtctcattaagatccaaggttcttgtctgttctagtgagtttgagctggcaagaataatacttgtcatctgaaaagtccattagaatcctttggaggagtgagactggaaaattggagacatattattatattttaaaatatgccacctttctataataggagtatgtggggagactgccttgttttggcttcttgggaaaatttggaaaattagtaaaataggcaggcagtagtagttcaatgcgtattgtatgccaaacactgaatttagaacaatactcccccaaaagcatatgtgctctaaattttatttttcacttaccacctgggagatttggattaaatttcttctgggaaatagagttggtatgaagaaacaaagaccactataccaatttatctgttggaataatcatttagccgtacagctctttccactcataaagttaatgaggtcattattgttctttctagctaatagataggcatattgaaaccttaggcctttccaaaaagtctccataagccattggaaagatagactaaaacactccttgttttaaattctagacctcagttcagtcagagatagtaggatttttgcagtattattaaaaagacagaaaccagctataaaattgaaatgaagggacttaatgttttttttctgtaatatctttggaatgcttccatggctttaaaatgctgaggtgtttctcactatttttcaaaagcatgtaacatgtagatatgtgacgcaaacttgaccagttgttcctcttttctggtgaattttgacacctgctactattacacagagtaaaagtgaaagtcataaaacagaaatacttaccaaagtcaagaaaaatgcatagactaaacaaaggggcaagagaagcctattacttgtttcatgtttcaaaataaaagatgaatggcctatcacttcagtagttggaaattcaacttgagaaggtaggtggtttgatgtttgcccttgttccttacgtttctagatttctctatttataggctagaaccagccctggataaaataatacaagttatgaagagaaatgtgcagttcagcatttttacccttctgaagtgcgctttctcccagctgccatggaaacatggcgtaactggtttcttggatagtctcactcctcttgagttccggctgtgagagctagtgagctcattacaacttggatcagagtcctggaaagtcagctcccagggaaagtggaggacagtctctcatggggcacgggaatggggggctttagctttattaaactgcatacatactttcactacacagtcatcccaagctttagcccaggacagtgtcacattgttcacagctgtattgcatcttgaggtttctgtgtgcatcctacacactttcctaaggcagagacttatctcttccagctgtaagccggagggagtggtgctgcagactcctagcaacacatgcggactcaaacaacacaggcagttaactctcttgagtagtagacttgtagggcaccagaactccgttgcagttcactgacagttaccagatatacatttgtatggcttccgtagcattgtgatggaagctaaacgtttgccctgctactttcttttttttttttttttatttttttattttttttttattatactttaagttttagggtacatgtgcacattgtgcaggttagttacatatgtatacatgtgccatgctggtgcgctgcacccactaactcgtcatctagcattaggtatatcacccagtgctatcccccccactccccccaccccaccacagtccccagagtgtgatattccccttcctgtgtccatgtgatctcattgttcaattcccacctatgagtgagaatatgcggtgtttggttttttgttcttgcgatagtttactgagaatgatgatttccaatttcatccatgtccctacaaaggacatgaactcatccttttttatggctgcatagtattccatggtgtatatgtgccacattttcttaatccagtctatcattgttggacatttgggttggttccaagtctttgctattgtgaataatgccacaatgtgaaggacctcttcaaggagaactacaaaccactgctcaaggaaataaaagaggatacaaacaaatggaagaacattccatgctcatgggtaggaagaatcaatatcgtgaaaatggtcatactgcccaaggtaatttacagattcaatgccatccccatcaagctaccaatgactttcttcacagaattggaaaaaactactttaaagttcatatggaaccaaaaaagagcccgcattgccaagtcagtcctaagccaaaagaacaaagctggaggcattccctgctactttcttctggtatgcctgaatcactgtttgagaatggattggactttggtgcgtggaaaactggtagcagaaggcttattcactgcagtgggttgggggtaggctgaaaagatgtcagggaggattaactagaggcagaatgtgtcatagttagaagtatttagaagggaagaaagtttgaactctgatactgttccacactaatattcatgccctgaaagaatcagatcattcttgcctctcccacttggatctctagctactggaatttgccaattcttgatatgaacgctaagatttggatggagcttgtgacctcatttagaccatttgttctaaatgctgaatagaaccaggaaaataggaaaagagggtagaattggggtcataagagaggaatcgtcgttctttgaaagaagaaagatgataggaaactaggcacatgagttacgaggcagtggagaaggaggattagaaagggaaaaaaagaagagaaactttatgccaatatcttctacaagatgtttggctggcacaaaactaacactcaatacttttgcataagtaaaggaatgagagaaaatttgggattggatgcttatcccctggaaactgctacaggctggtgttaatgggaaagggatctgtatttgaccaaaagtgcatttccacgtctctacatttctttttataaagagtcaaagggactcaatgatgagtgtgtgtgtaagggaactccacactagcaagtacaggaaaaatttgatggtactggtgaaggatgttgcaccaatctggaggggaggacaggaattggtttctcatggattgatgccgcaagacaattcataccatgagttggctgagaccacttaaaaaagtaagcagtgatgactgggcaaaagagacaaaggaagaaccacatcttttaggggagagagagagaaggacaattaaagggactcaactagatcaagttctgctcactaaaggacagcgtccaggcaaatgttaattatcttcaagaagcaatctgtatatatagcatttcaagatactccgagatgcttttaatttattgaatactttttattggtatttatcataaacaagagactcacaaatatatcccagaggggaggttttggtgtagttgactatagtagttattaaataatctattaataaaagcccacaaaatggaagatagaaagatagaaaaacaaaagacaacacaggatggtgttggtatacagaatttatacttgaagtttaacaacacggaacaagaaactttattaaaatattcatttaaagaacttccatatgaatcaccagaggctcttagtaaaatattgattcggattcacagatctgggtggggcctgagattctgcatttctcataagctccaagcagatactgatgctattcttcctcaaatcacactttgactaacaaggactcacacaggttctctgtaattggtgttggtagtcattcatggttagatgtagttgaggactgccctcttaactacctctcggctgccaggttataaagaaagcaagtctcagtacaagttctgtcacttaggagcatttattagccaatgggtacaaaacaatcttacagcctgtgccagagacacagtgaagtcacagttctgtcttttggggtgcttggtgtgagaggctcacagtctacacaggccacagtcctctattagagtggttctcaaagtgtggtccctggaccagcagcatcagcatcacctggaaacttgctagaaattcagattcccaggcccttcccatacctactgaattagaaaatctggaggtggggcctaggaaatctgcatctttaaactatccactccaggtgattctgatgtttgctcaagtctgaaaaccattgttctagcagcaggattccctcaaccatctaactgaattctggcaactaagaatccggtgaaccacagctggacattttggaattcagcctagggcaccatttctaaagatggagaacctactggattcttcttaaactcaatttaaaggcagggagtgtttctaaatgtttttcaacaatcttcatattttgcaaaccactaatatcactacacaggcccgtctaactattaattaggaaaattaatgaaacccctggtgtaataagagctaaatataactgaatcacttacagtggccgcctgtggcatgaggctttttgattaattgctagccaaccacccttggagttcactcctgattaagacaactgaccacctctacagtgtagcttaagctaacacacacatacatcagagtgtactgttcatgtgagggtttttaaagactcttaaaatttaccttatcagggcataatttaaacactataacatgtttccattttaagtgttcaggttagattttggcaaatgtatacactcgtgtaaccaccatgccaatcaagatataacatttcgatcacctagaaaacacccttgtgttcctttgaggtcagttacctactcccaccacaccccaggctaccatctggcatagtagctaagttttgcctgttctagaagttgatataagtgaaatcaaacagtatgtactgttttgtgcctggcttcttttacccagcttagtgtttttcagatcagttcacattgttgcattatcagtagttagttcctttttattgcactttgcacagtagtatcccactgaatgactttaccacaacttgtttatccattaccttactggttggtttccggtttttgactattatgaataaagctgctatggatattcatgtacacatctttttgtggacatacatttttttttattctgtgcaaatatccaggaaaagaatatttgagtcataatatacatgtgtgtttaatttcataagaaactgcctaactggtttcccaaagttgtcgtacattcccaacaagcagtgtctgagaattccagtcgctccatatcctcaccaacatttggtattccggtcttttaaacaaaattgtatgctgaatagtttaaattacagacattgttttctttcccctagttgaaattcaggcttttatgtttggtctctgcgatggccataaagctgaaaatgttgacccaagtgacttggatatggattgaattattgccctttcctaacacctcatcagaattggtttcgtaggtgtcatttgattatggcagtcatgtatgtcagtgtactttttctttctttcattcttttgtttattgattcagttggtcagtcggtccatgatctgtattaaaacagctttttcagagggcagttgcatattaagttgctaggaaaaatgacagaagtaggtgacagagttcttgtcttcaaggagctttttggagctgagttcctgaaataaatgtagcccagtatctatcaaggcttgtgcagacttgagtaagaacatcatctaaatatagcttcctgctaggtggcgtgagtcagggcttgatagaccggtgactgcagaaaccacagtaacatatattgttgttattctgtgctgaacattagaatgattgtaccttagaatatagagccaaatgtttattttattcctaattatatttttaaatacatatcacacacatagacacatatgttggataaaaaatactcaaaatgttaacagtgcttatttaaaaggtttatataaactttttttgtagagatgggatctcactatgttgcccaagctggtcttaagctcctggcctcaagcagtcctcccaccttggcctctcaaagcgttgggattacaggcatgagccactgaatccagccagttgtgcctatttttgagtttatgggcttgtggatgatttatttgattatatatgtatatgttaaatgtctaagttacccaaagtgagcatgtataacttctacagtcagaaaaaatgttatattgccacttgattgtttaaggtcttatagctatttaaataatgtatttcttgttctctttaatcttgtgcagaaaagattcactacagtagatccagattactttctagaaaaaaataatgcctgtccatctctttcctcttgggaacaggactacatgaatgcccttcaggctataccactttagtcttcacagaacttagccttcctggttgtcaaagggcaaaaggaattattttttcttttccccacgttaacagaattttcacctccgaaagcttggcgtatacacactatatgttttctaggctatttttgtggtggttgtagttattggcaaatcactgggcgtcgggggtgggttgtctgttatttctgatggaataacaaatgctctttgttttccctcttttcagctgacctgaataatgtcagattctcagcttataggactgccatgaaactccgaagactgcagaaggccctttgctgtaagtattggccagtatttgaagatcttgatactatgtctttgcttagaataaaaagtaggttgggtacatttttacttagagaggggagaaacagctgtcacaattcctgttgcaatgtataattcattctttaatgtatccttggcctagagtttgcctagaatgttttgttttatttttagaatcattcctgtcaccattcctcagctactgatgttgaattaagatattgagaatttttattttccaactactggcattggcatcggcatccataattacctttgtgaaacttgcacaatccttgttctacctttgtttttttttctttttacaaaatgtacttagtattagaagactatgactatctgatctaaaccaaacttcatagacatgtgtggtttattagcttgaatgctaacgtgcagatgaatgaagtggtagaggaaaaatgacagaattgctttcctccttttttatcatacatctgtggaaaaatcctgaagtgttacacagctctatcatgtcatcaaatagtttatgtataactctactattgtctgagggtctgtgtgcattgatgatatgcccatgaaacaggcacagtttctttttctttttttctgtttttttttttttttttttttttttgagatggagtcttgctctgttgcccaggctggagtgcagtggagtggcgcaatatgggctcactgcaacctccacctcccaggttcaagtgattctcctgcgtcagcctcccaggtagctgggattacaggcatgccccaccatgcccggctaatttttgttttttgtttgtttgtttgtttgttttgtttttttttgagacagagtctcgctctgtcaccctggctggagtgcagtggcgcgttctaggctcactgcagactccacctcccgggttcacgccattctcctggctcagcctccggagtagctgggactacaggcacccaccaccacgcctggctaattttgtttttgtaattttagtagaggcggggtttcaccgtgttagccaggatggtctcgatctcctgaccttgtgatccgccctcctcggcctcccaaagtgctgggattacaggcatgagccaccacgcccggcctaatttttgtattttttaatagagacggggtttcaccatgttggtcaggctggtctcgaactcctgacctcaggtgattcacccgcctcagcctcccaaagtgctgggattacaggcgtgagccaatgcgcccggcccaacaggcacagtttctgctctgatggaacttacagtctaacaagggataaccaggatgttcatgaaatttgtagacataagcaaatatatgtataatgtattaagaatgtctacagttggttaaaaaaataaagtgatcttgtctctatttccaagaccatttcaatgtcatatatttagttgtgcaacagtgggacaatggggtactatgtgaacagctaactgtgtggaatgagattcaaagaatgtttgtttgaagaggtgatgtctaagctaggtaactctagaagagtaagcagctctctctctaggaagagcgttctagtcagaaagaagagcatgtgctgaagggcccagagaaagcatgacacattcaggaactgaaaatatgtcagtatggctaaagcacagaattccaggggaaagatctattgtgaaataataggctggagagagaagcaggaagcagattgtgcaaggtttttaaaacccaagttaaggaatttagaggtcaggggatttggcctgggggtgacataatcagattgtcgcttagaaagatgattcttgctgtggaacagagtatggattggtgcgatgtgggagtgacaggagaaaaacctgttgcagtaatctaaaccagcaatgtggtggcttgaattagcagagtagtaagggagataagtggagagaatttagaaatatttaggaagtggatttgacaggcctcagtgattcatttgatgtggtgcagggatgtccaatcttttggcttctccgggccacagtggaagaagaattgtcttggaccccacataaaatacactaacgctaacggtagctgatgagctaaaaaaaaaaaaaaaaaaaaaaaaatcgcaaaaaaaaaaaaaaatgttttaggaaagtttacgaattcatttgggcctcattcaaagccatcctgggccacaggttggacaagcttgatgtggtgggtgaaagggagtcaaggaagacacttaggtgcttggcttggaatatcaggtgaatgtgggacttgtctggtaaggttagacacggagctgtggtgctcaggagaaatatacaaacaacgtttagggatcatgagcctgtaggtgctgcttgtaacgggggagaggattggatagctccaggaaagtgtagcgtgagaagggaagttatttaggacacaggataagcaacctacagaagggactgcaaaggaatggccaggaggaaagaaggaaaattccaagaggttatgatgccacatgctccatgggaagaaagaaagaacccgttaccagggtcagatgttgctgggatgtcagcataaagttgcggaaaatgcccattggacttagcaacaggaaggtccctagtaactttggtgagattttagaggcacagtggaagtggtgtggtgagttcaaaagtgaaccaaaagtggagaattagagaaggtatgaatgattcttggagaaatttacttatgaaggggagaagagtggggtggtagctagttggagggggctgaggagttaatggaaatgtatgtacagtcacgtgttgcttaacaatggggatatgttctaagaaatgtgttgttaggcaactttgttgttatgtcaatataggagagtactacacaaacttagatggtatagcctagtacacacctaggctgtatgggatagcctattgctcctaggctatacacctgtacagcacgtgactgttctgaatactgtaggcagttggaacacaatagtaagtattgtgtatcgaaacgtatttaaacatagaaagatacagtaaaaatatataatagtgtaatctcatgggctcgctgtcatataggcagtccattgttgactgaaatgtcattatgtggcacaatatgtgtatataagtgtgtgtgtgtgtgtgtgtgtgtatacattgatccttgaacaacatgggtttgaactgcttgggtcaacttacgtggatttttttcaatcaaatgcaggccaaacatatagtattcgtgggaatgtatttatatgagtatgagaagacagggtgagattacaattattggcccaagaggagatgataaataatgggtgttctcagagaatacgggcaggtaatccagagcccaagggagggaagagatacctctcttccactgtaatgggtggggtagagggaaggatctgggcaggtccaggtaactaagaaaccaggtagcagcaaggtgaaggatgtcttactataaaggcttccattttttgtatggagtggagagtccctgcaacgcagttaacagcaggagatgatgaagttgggcttatctttgtggagaataagagagagggcggagttgaaaaccagctgtgtgaacccagaggcggctgagtgtttcacggtagctccaatctgcaggggtgtggtatttccccaggcacgcttagcacttgggagccagatgcttctgtcctggggtagggagggaacagctgggcaagagaagtgaggatttgggcaaaagattgattaaaatgatactgacaagtccctgttgggtaggagaagctgtgaacgcatatggaaactggtaattaggaggtagagggatgaaaatgctaactcttcagggaggtaggggaagaagtagtaaaggaactgaaggtcaagaagttgtggtcagagagaatcatagatgaacattattttgaaggtggaacagtttcaggtgattagatctaggatatagccatttgagtaggtggcagaggtagagtggatgtgaatttccatggaggtgaaatagcaagttaaggaactgagaggctagaatgatgcatgagtcccccatgccaatgttgaaatcatgcagaattggagcgagaactgggcaaaagagaaggaccgtgaaccctggctgccaggtcttcagaaataaaggggttcaaccagaggatctgcagaggctagcaataagatagtcaaggagtcacttggcatatggttcttacacagagatagagaagaaatgccttagaagtggaattatttggaaagagagactaggccttttcccttcatcttggtatccccaatgcttagtacaaaacctggcacacagcatggttcaatatgttttcatgagatgaatgcatgaatgaaagtaaaccaaggcttccatttccttatagcccgaagttatcatttttcagctatatagttgccaagtttaactggtgtttaaagggctttccaggtcgagggtttccttaggacctgttaatacgtcatagctgggaaaaagtagtttgggatgggatcgagtcagggggctgaatagagaaagttttcttgcctctttttcttcacctgcccctgcccctgcccctgccccatcccagagctactgctttcctttaataaaggagtaattaggcactggttatcatgaagtgctagagaatattcctgtgagatcctaaaagttcagaagctaaccatttgttccagtttatactatggaaaaaaaaaaaaaagaaacccagaaatagaccagatggaaaaaccttataatgactgttcctttctataatgtccattttcaccctggatttaggcattattcgattttcctgctcaaaaaaaattccattcacatatgtgttttattgtctgtcatttcaacttataatttccaataaactttgggaaaatgggggaatttcataatatacaaaattttgtccatttgaggtgataaccttgtaataaaggtaagctccgaatgtagaataatttctttaaattttcacttttaaatcaatttgaaattctctgcatttcctttctgagcatggcttttctaatatgtgaaaaagattcaagtatgccaaaattaaggtgtatgtatctaaattaagtattgaattctcattaatgctaggagggtgccatatatagtaaaactatagaatgaagagttcaccccatccttttattgaacatatgtgtggtcacattacttactttcaatatatgatttaagaattttctcctaattttatatttgcttagatttagcttccaggcttttgtcatttctaagcctgcaaagccatgataaagagctattgtctgcggtacaggcaaataaaacttgccctggctagctttccctaccaaaggccacttctaccaactctaactttaaggaaaattaatgatgttatctcagtgatttcctggtgccagtgaagagtttgaattacagatgccttggaaatatgcacttccacctctattaagcacttgatcttatttttttttcacttccctatcaatgtttccgtattgcagaaagccaaataacccaattgtatccactatagagaattcactatttaagtggagagcatcaccgttggcctataatgtccccagtttgtaatcagttaagtgttgcatgactccttactgcctctcaacacattggaaatgaaaatgaaacttggtagaaaagcaggaacaaagataaaatcttggtaagaaggatttataaactgtttcatatagctgatactccattgaaagttatgaagaaggtaatttaagcattttctttctccctttgtagttctgatgacattctacaggtgtgaggcttctaaaattaaaaagccaacttgtaagagcagaaataaaaacgcacttaacaaagcaagtgtatttagtttattaataatgtgtggtgggttggagagagcccaaaccatagggctaaatatactgcagttgataagtgtgacaaatattctgcaaacagtaagaaatagagaacattttgcctctattcagcaactaaagcacacattatagagatttggtacaggctggagttgtgtgaatagtcacagtttctggactcgccctcaccatgacaaaccaggtgaaaaatgcaccgccttctctgtaaatgcacctcaccttttgatggtgcgctaagggtgacattagataggcttcagttgctaaagaagactctcaggacccacaataacatggcttacaaatccgcgctctattgccagaaaaggctacattacaagagcattactgtcaggatatggatccacagccacaggctgcctccacagcaagggggtctcgagaggccagtgtaattattttgccactgtcctacaaaaatctactttttctatataccatgtattatttttcacataggttagaggccatgtctctgttagttctgagtttaagacgtcttgaggacatggccaaactaattttctcagtttatatggtttgacagatattagtgcccaagagaggtctcataacatgacccatctatctcccaggggaaatactgtaatcttgtttagctgttacccactagggaaagaatggttttctctcagtcagatgctaaagagattaaagaacacctcgtaggttccgttttctagtaattattggttccattctccagctatcaaccttggcagcttgccatccctatccttcctcctggaattggatgcccttgaagtgcgcttcttgcactaggaagtctttctcgtcagtttatcatttctcattcaaagcaaattctacctggccaggtatctctagcccagttcctaattctcctaatagaagtttcttttatttcaagtggattcatgccccttggcccaccagacatgttgccattgagaaatagcagctttaatgggaaatacacatgagacacaaaaatgtgactaggctaaaatcatatgaatagtagtcactcctaaaaggactttggtttgggtatgtcacagaaatttctgtagccatccatatccaatttctagcttttcagtctcaggaaagtaggcccaccaaattcaacttaaatatctgtcactgattcaagctgtcccaattgtccctccacccactaatggctttccacacggagtaatggggcaaatagctatttttttaaacacataatgttatgacagatgaaacatacagcacgtaagccttctatcacatgcccaatacctttgttaaaccttcatcatcacaattgatggccacacagtgtttattgagattgttataaatcattgttcttcagatttgactgggtaaatattccctcaggttatttcctgacacagctgattaataacagatatgtcctgtgaaagaagaaccaaaagacattaacgaatactaaccaaaagccacattaatattgctccatggtgttgtagtcgcagttagaacgcccatctcgtcatccagtgtgttggataggttggctgactctcccactcacatcttggctctttcaaggaggaggaggttttagcagagtcccccaccccaagaggcatctgagtctaagccaagggagcatattattctcttattttaaacctctccgtaggcagcaacattatattaggttttccctttaaaaaaaaaaaaaagtatcggctgggctcggtggctcacgcctgtaatcccagcacttcgggaggccgaggcaggcagatcacgaggtcaggagttcgaggccatcctggctaacacggtgaaaccccatctctactaaaaatacaaaaaattagccaggcgtgatggcgagcgactgtagtcccagctactcgggagtctgaggcaggagaatggcgtgaacctgggaggcggagcttgcagcgagccgagatcgcgccactgtcctccagcctgggtgacagagcaagactcggtctcaaaaaaaaaaaaaaaaaaaaaagaaaaaagaaataaaaaagtatctttggtggtttccttccccttgcaacaatctcacctttttccttttatcattaattttaagccaaacctcttccccagctacacacacacaccacacaatgcagacagtccccaacttgtgaagtttcaacttaacaattttttgatttcacagtgatgcaaagtgatatgcattcaatagaaactctacttctagatttgaattttgatcttttccaaggctagtaatatgcggtatgatactctctccccttgctgggcagcagcactgaacctcagctcccagtcagccacaagatcatgaggctaaacaactgacactttactgtgtaaggtgttgctagacagttttgcccaactgtaggccgatgtaagtgttgggagcacattgaaggtaggctaggctaagctgtgagtttcagttagttaggtgtattaaatgcatttgtgacttaagatattttcaacctatgatggggttgtgtgatagcttcaattaggcaaggcacaaggaaggagtaatccattccattgatccttgtggaatgcttgtgcttaagtaccaactaatagccatagtatcttattttggaatattaccagcctttgaaactcttaattgtagccccagttcagggactactaggtctggcatcaaaaaagaaacctgtagtgacatagggaatacctgtaagtgccccacttgaattatctttttaattgtaactggtctcacaggtgtagcccatttctcaaaaatgatagttgcttcagctttttggttgggactccacctgcaggccagagagggtgaagcccagtggaaagaaattctgaacttaacattagcttttggatttttttttagcagccttgccatcagtttgcaattgcctcctaatccattttgttagctccttaggttcaagttctctcacttccagattccactagaaagttacaccatcagtaaccaatttcaaagcctgtgttacttttcaaccaagcgtagcttgttgagcaacttcaaaggttctttttcatcccttttatcagaatcttctttttttctttctaaataatgcctcagtcatacttttagctaagaatgagttggaggtgttctaaacaatcttgcttctgacactcactgccctgacagtggaagttaaacagggttcaattgctaaagaggactcacaggaaccaaatgacagtgcttacgaatctagagttccttgcagaaaaaggatgcaatatacccacaacattaaaacaagaataagtgtcacagccacagcctgcctcacagcatagggtccagagaggacaggtgcaagctataattgccctctgtctgcaagagccacaccacgatgcattttctctcttggaacaagagctactgatgtgagcacagaacaccttggaaaccagggagcacaaattggagtttcagccagggtttcttatatcccgtgggtaacctaggcatactgttcctatgtaaccagcctcaaactcagtggcttccgttggtctgactgtgcccgggtaaaaatggtcaatgttactgttagcaataaacaatggtgataacctgcaacccatggctacacttcaacacagtaagtcactttgaaaagcaagtgctttgaccagggctctgcactgtgtagatattttagcaagtcatctcgtgccaactccagcctctctggaattaacccttactgcacagacaactacatcaaagtgcattgactttcttgaagtgcaaagatttgcttgggaggtccctcagccataagtgtaagttgcctgtagagtggcatgcctgggcaagaaaaatcagcaaacatacagcagttcttccaccattactcacctctttctgtttctgtgctaattagatcacagaattatttatacatcaacatagaatatacagattgacctataggatgaacttggggttatatgggcaccatgagactttttttttctccactaaccaactttttggtgcttctgttttatcctactgttgtcattagcatggaatgcagaatggttttcctgttctgtaaagtcagtaaggacaccttctgccacccacttttcccccttacaatatgtacctccatgagaaatcagaaaacctagatatcctgccataacacccagagtgagtctccatatctctggtctcagttgtctcaactgcaaaatgattttaaagcaaccttctggctctaagagtctatcactctgtaaaagacaaaaaaaatctgtcttacataggaaggaatagcaagagttagctactgtggcatacatagaaaggaaaagaatgagcttttgaagctagaaggttgagaagatgattaggcacaaccagagcctcaggaaccattagtgggatccctgtgttgaagtcctgcctgctcgccgccccccaaccgccactgtctgcttttcctgcacagcaaagaggatcctggagagtcagccatttcttttatcctgtccccaccctctctcacccccacagccctcatgcatagggtaccaccacatggtccctgttcttcaatggcttcaaagcctatagcatcctctactgtaaacataatttagaaagtgaagatgtattagaatacttgggtttttatgtagctttaaagatatatctactagtgaatacacacaaacacacacacacacacacacacatacacacacacatatatatatatatatatataatatatttaatggaaattcctagcttaaggaaacaatggtttcacacaactgtatctgctggttgcttattgagggtcctagaaagagctaatcattacatttaatgtttcatcaaaaagtctaggtgtgttctctaagatgctcattttgaaaagcatatgcatggcaattaaattgtccctattgatattctcacctccttttcgggtccatagcatggattgtgtatacctaaatggaaattttttcaaaatagctccatgaaagttgaattctgtttgacatgtttgtttagggaaatgtgctcttcagtcttctgtgatggattgttcttgtgtttaaccacatccagttttagcagagcacactgcacagtatttctctcctaactgtgtcatcttctgctcctgtaatttcagagcaattgctttgctcccctctggagctatttctactcaacatttgctgttctatgtgttacccattcacctgtacagagataagagcaggccccataaaatgaaatgcatgcagtttttctctgttcatttccatcacacggctaaataagactcttaatacaaaagtgattcgaaaaattttcactagttacttcttaaatgcctggatcagaggcaaaatatttatgatgactaaagcagagtaacaaaaaagaaaataattgaaaaacttcaaaccacccatagcttccttcagtatataaggaaacatgttgggaatattggtgtttggaagaaatccattcctctcttccagtaatggagctggcataccgtgtttctaagtgttcctactacgtgcacttgagtatgtgccctctgaggaaaacaagcacacagaagagagagagaagaaaagtttgagtcttttgtctctggacctcgctccagcctcccacgcagtcttctttcagccattccctcctcacgtcctcccgtcctcctgcctccttgcattgctttttaaaattctttattatttttctcacttgattcttcagataagtctcccaagttatcttccttcctcccactttaaagaaagtctcagcttccatgaaaagggtcatttctctatctttagagtatttcagagcaaaaacagaggggccttcccttccaagggaggagtgcagactcctgcttccaccaccatgtctgtttcatgcttctggggaaactccaggattttctgttttcctttttttaaaagagaaaaatgtgtgcgcaatataggtggaaaagtatttttgcacaaacctacataggtattaaccactatttttgtttttttcttaatatttaattagaactggccatgaataacttgtaaaatatactaaagccttaagtttgcatttctttattactgggaaaggtgtttactgagcgggatttacctctatttatgtgaactacatttataattgaattgccccttccccctagatgcatgagagatttacttaattagcattgattccttgcctcaaaggactgagaattccaaccagagcttaggtgtataaggtagtataaaagcaatgttgttgtgtttctagtttggctaataaattggctttagagaaatgcatcttttcatgacacttgggaataaagcttgtgatttgctgatgttggacaaggttgaagtttcacttttgttaaatttttgtccccagcataagattaaacacctcctcagatcaagggaattttcctccctcagccttataaagttgttagaggacttagaaagaatattatgaaatacaatttgaaggtgaaaggagaaataagcgagcctcaggtctgaaaactggatagattatgcaattactttagtttgcctatagaaaattttagtggagagtatttttttcacctaatattagggtagcagagagatgctgaggtgactgatatttcaaggagaaaagcgcttaatgattataaatgcatagctagaaatagagtttacacaaccttagccatacagattaatctaacagatcttctctaatgctaatacaagaaagtatcatcggatctctttaaaaatttctgctaaaacattttttttttcttattcaggtgacaattgactctgtttatgtagaacaggctaggtccccttaactctcagatattccccagtaatccaaggatgggaattatatctttgcccatatcttcacccaatgccagtgagatttaagaacaacttcagatcctgaatactgatcaaactcatcaacttagagtcgaggcataaaaataaaacacctttcaaagagagtgtggttcacgtttggtgtttattaaagggtatgagagagtcctagctaggattctcagaggaaaaaggacactgaaaggaaggttttactctttgagtcatttgtgattttatttgttttttgcagtggatctcttgagcctgtcagctgcatgtgatgccttggaccagcacaacctcaagcaaaatgaccagcccatggatatcctgcagattattaattgtttgaccactatttatgaccgcctggagcaagagcacaacaatttggtcaacgtccctctctgcgtggatatgtgtctgaactggctgctgaatgtttatgatacgtacgtatggcatgtttttatttcccgggctctgtcacaggaggcttagcgtacagaatggtgaagtgtaattagcattacaacagggccctggaagctgtggacctaatgctcttcctgtgataaatcatttttgcatttatgacttgaaaaatattttgataagctaggagttaagagccagaatgtagattgctctcagattagaaaacaaacaaaaccctgagacactcattttgcaaatagtggaatgagtcgacatatagcctttggttctttccctttctcgcccatggattttggaattcttccatgcacttcaggggtggcttcctctcactggcggccatggctgtgctcctggagatactggcacacctgtctccagatcagaatggtcttagctgatacttaggacacttttgcagaagattatgaattgataggccaaacaaaatgaaaacaagcccttaatacagcaaacttagcttctcaaactgagaacatttttcgttttcttttgttttttaataagattttatgaagtttcagtttggcgcctccattcatcactctctcttagagaacaattgtttgttttggattgcacacaagggagatatccccagttctgatttttttttttcttgagcttaatgaagacaattgaagaagggagcagaaggaattggtcttaattttgcctaaattcttcttagatctcaaaattattacatgcctcatttcaccaatcaagaacatactcccatttggaaatctgggaaggttttctgaaaagagttgcaaaacaactgttttgccttttacctttgttgtagacttctactaccttttgaactaaaatttatacctttttttctttcttattttgataaggtattgctttttaaaatttcaggaccacctgactattacattcatcatagtcatctaccaagtccttgaacatgtcggatttcaattgtgaactacgttcacattagttttgataagagtttgtattcaggtttcccctcaaatatattttggcactgttttctttgcagatgacatgtgaatgcattctgaatgtataacttccttctacctgactgaaaagtatttggtgacaattttaactccttgaagacctgagttgctgtataaagtggatttgttaaattttgatctaccttttcttaagagggagaaagataagaaaattttccagtgataggaatttgtttagtccattagtgcccaggatttctttttgactgagggatttaataaattttagtagctggaagttgagcatattgttcaccgaaaataaccgccattgggacctatcctttgtgattttgaagtgctaataggcgaattattctgaaatattttctcctttttctttttaccaatatctaagggccagtagctttccgtaataaaataagaagccaaaaaactattgaaagacactttttaactttaattttaggtttcggggtattatgtgaaggtctgttacataggtaaactcacgtcacgggggtttgttgtacagattatttcatcactcaggtattaacccatttatgcctagtgttccattattggaacactaagcttgtgggaattattcctatcctactgctcaaggtcatcgccaaggtctgattttcacaaaaagtaatatgcagcctccagcataaatgggttaagcgcagtacccaacagttgtcttttctgctcctctccctccttccaccctccaccctcaagaccccagtatctgttgttcccttgtgttcgtgagctctcatcatttagcttccacttagaagtgagaacatgcagtatttacttttctgtttctgcattagtttgctaaggataatagtctccagctaatccgtgttcaaaagacatgatctcattcttttttatagctgcatggtattccatagtgtatatgtaccatatttctcattgatgggcattcatattgattccatgtcttgaaagacattttctacaaaatggaaaacttttcattcttatttttcctttttttcccccatggataaaattagcttattaataaatttgttatgtgaaatgctttatttcagttttctatatgcaaatatagaaaatgctatgcaaataaaagcaatctatattaaaacactgatatagcaacaggttatttataaatttattttttagatcatatatttgaatgttgtttaatagagtatgatatttttcttacggagataaacatttatattctatattatgtgttatgtggcctgaagtaattaattttctttcaataaggggcaatctgatgaagatctgagcatttaagagggctgagcagttagttgctggtaatttttttggcttccatgaccaaagtaggtaatttgctttagtaaccaaagtagattggtgaagattagtaattcttctgcttaccaacttaaaccaaggtggctttccataggtgaatagaatttttttttcttaatttatgtagaacttttgcagttcaaataagggtttttaggaattgaaacttggtaaacattcagtggtcaagttggttgaatttccattgcattgtaggtcatcagtcaaagagataatgaatttggaaaagttcaaaacaatcttaataaaacagtggtcaatagagttcacacatcattgagcactttactcctttatttttccttttcaaggctttattcttaactagaagtgtttaccctctaggaaagggtcagtaattgttttctgctttgattcttcataataggggacgaacagggaggatccgtgtcctgtcttttaaaactggcatcatttccctgtgtaaagcacatttggaagacaagtacagatgtaagtcgtgtatattaatgctgtattcttttattaatgttggctaattaccctagttctagatgggaaatgacagactgttcttatttgacagcagattcctcatgtaagatgtagaactgcttttagagtgtcataaaatttggtttgtgccattccttgtcaaacattaaattgcaggcatttaagtagagaatgaggattagcttttccagtccaggtattattttacattacattgactgtgtctgaataaaacacatgttcctaggggataaagtctgattttctaacctctttctgtaagtcggaaaaataagtgtgaagatttaatctctgcacttgtctagtctttgggttcttatttaaagaataccatgtgacattcatgttcaagaaacattgtttattttataatcatcttactgcaagttgtactgacacatccaattccgtgacgtgactaacattttattatttgagagacagatagcttgctgtttcttaaaggatagatacgtaccaccctacagaatttccttttgattacgcattgggttcttctgcttaaaaactgtaaaaccaaattaaaagccaatgctagaggagtgatggttcagatgaccaagtgaccatccattcatattgtgaaaggctgcagttggttttccccttgaaatgcttataagcaatcttttcagtaggaatattaaacaaattcagcctagcttgtcttttctctcttcccctgaggcctagccacacatgtgaggagatgtgctaagcttcaggacaggcaggagataaaagccactctgtctcctactgatcatttctccttcaggagtaagccacaaaatacacaaaccattttggccctcacttttatgtagtttccacttgagttttctcatcctcagaacgagagaaaaataactgaacagcttttgttaaccattttaaaatgtatttcggatgagatgggatacctgtgtgcttttctcctttaaatattgtagttacttagtataggttaggttctaatctaccgtatatatggtatagtgacagcacattgtaaatataatattaaattgaataattgaggaagctttgagttggtgtttcgaataactactaagagggaacatgtttttaggttggtgaaacaaaaatattaaatgcaaaatgagatgtttgaaagtaactcataactttgaaaataaacacctaggtatgtatatcggagagcagataaaaagctgtgcgtacaatctcaatttttagtgccatcttaggtatcctgttaaaacatttaatttcctagagtttaaagtgtgcttatgggtacagaaagctttcttggatttactttttttgaggggcaacttctaggtgaatataaggtatgattaaaattttatatctgagaacaaaacataacattgcaagcattcagtatgttcattcattctgttacatatattgggcacctactatccaccgggtactgccattctactgtagatacttctggcacacaactgaccaagatatggttccttccctcaaggggatataagtctcctgccaaaaacgatagacacatattgaatcaatgccagcataacatgatgtgagctattaattagaaatacgcagccaggcgcagtagctcacacctgtaatcccagcacttagggaggccgaggtaggaggatcacttgaggtcaggagttcaagaccagcctggccatcatggtgaaacacgtctccagtaaaaatacaaaaattagctgggtgtgatggcatgtgcctgtaatcgcagctactcaggcggctgaggcaggagaatggcttgaacccgggaggcagaggttgcggtgagcagagatcgcaccactgcactgcagcctgggcgacagagcaagactccgtctcaaaaaacaacaacaacaacaacaaactatgcacagtatcctgtgggaacacatacatgatggactagaagctcagtgatcttatgactccataaagaagtcccaactgtggtacatttttgaatctctggtgtccaaggagggtggtgctttgggccagttatatgtctcttaatgctaaaacacttattttttgatgtagttacatcctatatacaataattcccaaggattatgttctggcttagaagaaatttaagtgtcgagggtacgtgtaagcttgcgcttcttgcagtgacacagtttatgtaaaagttatcacacttcatatatatacagtgatcattaacttgattcataaaaataataaatatccagattagcacaaattagaagtaaccccactctgtggaaatactggctactcttgagaattgctactggaattgagttggatgtcaggttctgctggcatccatgggtgctgtgttttgactgttgcaattttcttcttcctttgtagaccttttcaagcaagtggcaagttcaacaggattttgtgaccagcgcaggctgggcctccttctgcatgattctatccaaattccaagacagttgggtgaagttgcatcctttgggggcagtaacattgagccaagtgtccggagctgcttccaatttgtaagttattcaccttctaggtaacatatttattctttcatattttagaaattaattaaaaaacccacagagcttcgttttctcatattagctcttcagtaggcagtaggtatgggatttgggatatttggaacctctgtaagtaagcagcttctggaactctaggttttgggaaagaagacagtgctgaggaaggaaaagaaatctccatctgcagcagggaccccacagttattgaggtgctagaggggaagaagttcagcaagggaggaaataagtctctagccacagaaatcctatgtatataagaaaatggcctttgtaggcgagtctcttagtctctgagtcctttctctaattctatcattatagcctcctttcaatggctgttggtaaattgttagcacagctgtccttttttttaaaactgtcctttgtagctttgacattcccctattattccaaagtctagaggtgtatactctctgctaatgtccatcactgactgaacacactcttgtccgttctctttcctatcctgtcccattgctttttctctgtcgtagtcagtgccccagaaacaccctcttcttcccaaatgcctgagcactccactggtagacattcatcttgttctaatttttttttctctttccttttttttttttttttcttttttgagttgcagtctcgctctgtcacccaggctggagtgcagtggtgagatctctgctcactgcaacctccacctcccgggttcaagtgattctgctacctcagcctcccgagtagctgggattacaggcgcccaccgccaccccaagctaatttttgtatttttagtagagacagggtttcaccaggttggccaggctggtctcaaactcctgacctcaggtgatccacctgcctcgaactcccaaagtgctcggattacaggcgtaagccaccgtgcctggcctctaatttttattaggtagatagtgctacaatgaacatccttatcgtttagcttttgtctttgaagctttctttataggatcaattctcaggcgtgtgattgccagacaaaataatataaacattttttgtggcctttcttcaaaagttgttctaattgtaacgctatcagtattgaaggagtaagatgctttcggtatcacattattcacagtgttcttatgtttttgtttttggttttttcaagtgctaagagctgtttttcttatgtagggtttctcaatccattctaattctattaacaatggctgagatttacaaaatggaactagctgtagaactaactgggttatatctgaagtctttgaccacagactaggatgaaactatagaaggtttcctgggcagatcactgtgaatatttaggtgtttaaagcagtttgagtatttatttaatagttagttggatagatttaccggatgcacacataataagttcatttatgtaaagtgggatatactgtttgaattattttgccaaaattatggcaaattagttgtaaatgtaaaatgcatgtggagaaataaatatcttttcctcctcatacccaaaccttccaaaatgcagatagatgatcaatccaatcaatcatcaaaatgtagacacaagtaacttccatacaatgaatattaatggccacaggcaatctaggttcattttgattttttaaaatccaattataaaacaacttgccataaacgcgagttatttcctaatcttttggttgtgtgttttttttgttttgttttgttttgagatggagtctccctctgtcgcccaggctggagtgcaatggcgcgatctcggctcactgcaacctccgcctccctggttcaagcaattgtcatgcctcagcctcccgagtagctgggattacagggtgcctgccaccatgcctggctaattttttgtggagacagggtttcaccatgttggccaggctgagctcaaactcctgatctcaagcaatccacctgcctcggcctcccaaagtgctgggattacaggtcctaatcatttttcccctttagtcaagtctcagttactctttgagttctagtgaaacacacacacgtgttcatatatagggatatataaacatatgtgtgtgcattgtgacttgggttaaaggtaaggctcagtgatggtccctgctgcaaagtaaactaggctgtattcagggccagctggattctttgttttctcgcccgagtactgactcatcaggaagccaccaccatcctcactgcagcctctggccctcttggatttggttgtcaggataagcggtggccatacagaagctctgctttccctgggctgccccccttatcaggagaccaacctattccatttctgcctgctacatccttttgctggataacctcctactcccctaagcccatgtctctggtttggttacatttctgtctctgtaataacaactctgtattctcagtctcaaagctttgaattcagtccatccttgcatatttgttgaatgcctcctggttggccagccagtctccaagctctttgaaatgtgaaatgtgttttgttttgttttcagaaggggtctaacttcgtcacccaggctggagtgcagtggcacgatcacagctcattgcagcctcgacctctgggctcaagtgatcctcccacctcagcctcctgagtagctgggactacaggcatggaccgccacgcctggcatttttttggtgtatgtgtgtgtgtgtgcgtgtgtgtgtgtgtgtgtgtgtgtgtgtgtgtgtgtgtgtacagggtctctcgccatgttgcctaggctggtctcgagctcttgggctcaagctgtccacccacctcagcctcccaaaatgttgggagtacaggcgtgagccacggcatccagccttgaaatgttttctatgagactggggggaaatcagtcaagatatgaatggtggtaacaggtggcttttgattttctctgtactatttttattttctgagttttcttctttgaacatttataattagaaaaaaaattagtaaagtgctgcctctttttttagggaaagaaacatgttttgtttgattgctttccattgccattcttacattgtttccaggccttctcatcattgcactggcttcctagcaagcctccacttcacactccagtccttttcattggtcttattgccctcatactagttttagagaaaagcatttcccatatgatgccgtccttgaaaatgtcagtatctttctgttgtctagtgaacaaatcctaattcctctatttaactctcagacctttcctactctggtttcataaccacccatagtttgctttcactatcatgaaacagcttctccttaccatttgtacctattatgcttataaataatattgttaccattgctactaacaaaactttgttcacatgaattctctcatttaatcctcaccaagtctttgaggggaacagaatagtcaggctttggagattttgcttttattattgtttaagtggatgaataatttatttgcgcccttaaagtccctcagctggtggaagggtttgattcctagtccagtatgcccaccgccacatttactacctcattcccaaatatgtagtttctgatacttctgctctccagcttcccaaggccaaacaacagctacttttcctgagtcctggatagaataagaaaaggtataacaagacaggggacccttgagggggaagaggaattagtttgaagtgctggcaaatgtagtatttctaatcagatgctagtaaattccatatgtatggcgaggctttcattacttagatttggggagcctctcagcgttttagcaatttgcaatcaggttgaatggatccattgtaaatacttaggaatacttaggaatccacgtcctggccctggcatgcttttcctcggccaggtgcactggcggtcaccttgcctttcattgtgccacgtgcataaaaatacaatgtttgctgtagggaaagataacaggagtgaaaatgtcctctgccctttgtttgaagtataggaccttcagaatgaggctgggctggttccttcagcaagcttgtgctcaaaggctgctatttctaccagcctgaggtaaacggtaataaagtacttgtttatcctacaagtgcattccttgcattgcagatttgatttcctttgatttcttgtcaccacctggaaaccttactttgtttcaggttggtacagttagaaaggtactgaatcttctgattcagacaagggcccagtagtggcaagaagagaggtacgtgtttgtgtgccacactctctggattatctattaaaggttttctcatatccctccccactaaccacttagaaaaggaaatcacctatcaggtctaaatgtaaaattttgcttatttaaaaatcactataggtcttccaaggaattatccattaagccaggaaatgaagtcacatccatggatatgaaaaaggaatagtcactgtaaatttatggctttgacagtggtatcttcgtagatactaaatgaggcaacaggatatgtttccacattaatagcatattgcagtcaacacatttactgggaaattgactcattttggtagtgatagaagtaaagttttgcaacgagtttaagagatacagctgtaattaatatattgccagcttgttcctttctcatattccatggaaacagccctgttgagagattagattgatttttacgaccttagtaaggccaagcctgccctggcagtgagtcacatagactgcctgaaggaaccttgaggattttctgcacctctcctttttcagatgagaaaacaggcccacagtggcacaatgaatctagtctacatcgtgcaatttacatcatgttatggcttcaaccagttcggagactagattgaaatgacagagtgttaatgtgtcaatgtgatcccctatatgaattttagattgtaatagaatgagatagataaataaacacccctcccccaaaacacatacatgcacacacacccatctttattgaaaatactctaatcccaacatagctgtttagtctatcttcagataaaaccaagtatcacttttaggtgggaaaactatacagtcatgtgctgaagaatgacgttttggtcaatgacaggccatatatactatggtggtcccataagatcaacgtaagaagagattataatggaactgaaaaattcgcattactttgtgacactgtagccattgtaacatcatagcacgaagaattatttcacaaacctgcactgccagtcatttaacaggtaaaaaagtatgttttaaaatatttttaattattatggacacataatagtactcatttatgggttacatgtgatattttgatacaagcatacaatgtgtagggtaacacaatcagagtaattggggtgtccatcatctcaaacattcatcatttctctggtaggaacattcccatttcactcttttagttattttgaaatatacaataaattattgttgccatgcatggtagcacgcacctgtaggaccagcgtttcaggaggctgaggtgggaggatcacttgcgcccaggaattcaaggctgtaatgcacaacaattgcacctgtgaatagtcactacactccaacatggacagcatagtgagaccctatctgtaaaaagatttaaaaatatattgattactatagtggccttattgtgctaccaaacactagatcatatttcttcttactgtatttttgtacccattaaccatcccttttttatcccccgatcttcactacatttcccagactctggtagtcatgattttactctatctccatgagttcaatttttttttttttttttttttttagctcccacacatgagtgagaacatgggatacttgtctttctgtgtgtggctgatctcaacataacgtcttccggttccgtacatgttgctgcaaataatgggatttcattttttatggctgaataatattccattatgtgtttatagtacattttctttatgcattcatccactgatgggcgcttaggttgattctatatcttggctattgtgaacaatgctgcagtcaacatgggagtgcagatatctttttgtggtttcgattttgtagtatcttcttcagtaaacattttaaggactttattgtttagataacgtcaagtataccaactttatattcaatatgcttcacctatgagagctggagtgtcaaaatctgtttattttacatctgttttctgcctcctgttgtacttagtattccaaatgagtaagttgcttttccatctatcttctgaatttctctatttgtatgacaaaaatgaataccatctatgcacagttgttgtaataatgtagaatgatatgaaaatgagaataaattacagtctcaactgttgagaacaagtatttctctgtgttagaaacattcccaattctactcttttagttattttgaaatatacaatgtattattgttgccatgcatggtggcatgcccctgtagtcccagctactcaggagactgaggtgggaggatcagtaacacataaatgagaaagcattccagaatatctggagaagtgactggcagagtggttaagtgcataggctttgaaaccgaactgtgcctgagtccaaatctgagctctgctatttgctggctgtgtgactgtggacacatttcttaaccttcctggcccctgaactcctggaggtgattgtgaggattaaatgaaccaatagaagcaaagcacttaagagctgtagtggatacatagaaggtgcccagtgaatgttagctatgattatctaaagtgtgttgtggcatgaaaatatcctgccaatgttaacagttgcttttatctataacaaaacatcatctgtggattgcattttagagattctggagattctgtttctctgcaaatgttaaaatgccatatcaggagacttttggctggttagacagcattccccgggtcaactgattacttttttttttttttttttttttttttttttttttttttttttttttttgagacagagtctcgctctgttgccaggctggagtccagtggtgccatctcggcacactgcaacctccacctcccaggttcaagtgattctcctgcctcagcctcccaagtagctgggactacaggcacgtgccaccacgcccagctaatttttgtatttttaatagagaaggtttcaccatgttggccaggatggtctcaatctcttgaccttgtgatccgcccacctcagcctcccaaagtgctgggattacaggcatgagccatcacacctggccgattccattttattaatagattttccatcctgaaagtaactcctaaaaaccctccttcacttaggtttcctttggctttttgtgtattaatcagactgtgggccctttggttccatagacattccttttacaccccttttggacggatgaatactcactagtaactaagtaattagtaagagttactacaatttggtatttataaagaggtggcctttcccagaattgaaggtagaccctaatagtccaatcagccttccatagagatagctggctgccatgaaaagctgagagatatcaccgacctcttactgggcctgctcatgaacagttagttaaaattcctgcaattttcagaaaagacccttatcagagtattatcagtattgtcttaagtttaatattggtttccagttgttatttttaaaaattttaagctaccgtgggttaagctttatgatgatctgtttaagtggtttgtttgattaacttctctattggagtaatggatgttttcttcaccagaattttgaagataggtttgtgttgtagttgaaacctgttttgtttatacacttactgctaaggaaaagcacatgtcattttgttttccatcttcatccttctaaagtagcacttcattgttatgaccaaatctttctttcttccttccttcctctcaccctgtcttttccttccttccttcctgccctccctcccgcctctcttcctttcctctcctctcctttcctttctttctttcttttctcttttctttcgttctctctctctccctccctccctctctctgtccccttctccttccctccttccttcctttcttccttccatttctatcacccctaaaattccatcatgctgtatcatctcactaagtcccaatctctggaaaccacagctctgttttctgttcctgtaattttgccttttcctgaactggattttaaaggattgtaggaggcagtagtggaagagctaactttatatcttgttcttttacataatgcgccctgatccacacttgggaaagtatattccatggtacctatagacagatatatgtgctttaccatgtatatgtgaaacttttctaatttaactttcctgttaaattagaactcggtagcataaattaatactgttgagtatacttagggatttgcatagatttaaaattgtgcatatgttccctagggccatggcgttaattggtttattagtcaggtggagtgcagagcctgaggtcaggacagttgtccttgaacatggaaatgaagagtggataatcaccatgtgttattgtttgggctgattttatctttaatgggtgattcagagtcctgattaatatttagagcagtgactgctggcctcctacctgctcattatcttcagaactttaaataaaatacttgatttctacccaagatggtagttatgggaagccttttacttcttcttgtctcacaaagacaactcttgacctctcaatccttaaacaaaaagttctgcttctgcgcatgtggggactcttaaactcattttcatgcctggagattcacatttagggatctaggaaaagcacatctaggcagagtcgatgaggagatgctttaagaaccgtgacaaggacaggaaggaaatcaattttgcgttaggtttgtatttttagagaaaacgaatcctggggaacttttcacactcattactattgacattaataccattgtcctgtccctttcacagttactaaaatcactcttgcccaccctcctgccttgcccacaacctattcccatgaaggggtgacttgggagaaataacggtttccaaccaacgttttattttggaaacatttcaagcacaaagagtagttgaaaggatagtctaaagaacactcatctgtgtcatacatctgttcaatccatggttgcttttcgctctacttacctcctccaccctctcagctctgtttatgtatgtgtctgtctgtgtacatacacacacaaacacattttcccctatgccatttaaaagtaaaggagcatcacaacataaacccctaaacacttcaccatacaccattttcttaaaggatgacattctctaacataactgcaatgctatcgttacacacaaatttaacagcaatccagcaataccctctgatatgcagtccacactgaactttccccagtgccccagaattgttccttatagccactgttttcttccagcatctagtcaaggtttttgtctgtcatgtctctgtaccttcatttagttttgaacagtctcccagcattttgttttcctttcatgacattgacttttttggtagggggacagagtctcgctctgtcacccaggctggagtgcagtggcgcaatctcggctcactgcaacctctgcttcccgagttcatgtgactctccacctcagcctcaggagtagctgggattacaggcatgcaccaccacacccggctgatttttgtatttttagtagagacagggtttcaccacgttggccaggctggtcttgaactcctgacctcaggtgatccacctgcctcggcctcccaaagtactggaattacaggtatcagccaccacgccgggctgacgttgacatttttgaagagttcagaccagttctcttgaagaatgtcccatactctgggcttttctgatggtttccttgtgattagattaatgttaacattttttggccaaaagacgataagatgatgctctgtacctaccactgtatcacaatctggaggaacaaaataacattttgttcctattggtatcactaagaatgttaaggtggtgtctacaagatactttccttgtaaaatatccttttccctttgtaatgagaaagtaattttttgatattttgacatattataatatccattccttaaccttttaccctatggttttagcatttatggatgatccttgtctaattcagttataatattggtggttgcataatggtggctttctaattctaccatactttctgcatgtattagaccattttcttatgtaaagaagagcttctacctctcccccgtctattcatgaatatcactgtggacatccaaggtggttctgagtgtacaaagaatgatatctctctttactgaactgccattggatactatttttgtcttggaattgtttaaaatggcagtgtatggaattgaaagtcctttctccagagagccacataaacagatgtctaataaatacatttccatattaaccaatccttttatgggaacaacacattgacataattaaaacacgtaacatgaaaactgtgctgaattgagaagctcatagagttttgtttcttttttttcctttttgccacttcaatatatatggacccgcacctgtcagtccaggtagctcatacatgccgtagcatctaatggtacgagggacatgtaatgctgaaaagaagggggaaaggagttgatcagatgagatataagtatgcatttatcagtgttgtggggtattcacttgcaccttccattggctctcgcagccatgttatcggcatataattcagttgaagatttatattcacctggaaattgtcctaagtgggccttgcttacttagctatcagactctagtactttcaaacaaattaaagattcaaaagattttggggatcgccttgctttttcccataggaaatcacttttgtcctgtctttttaagactattttaagcatatatttcagtattaaaatcgtagataatcttaagctgtttccttaacctctttgggccttttcttatctgtaacataaagttaaaacaggttatctcaaaagttacttatccctaagtgtctttgattctatgctaaatgttataaaggccgaaagggaaatggattattgtacttatttcaaagcttggccatgatcagcaaagtcttacctgatcttccgggtaacaactcttgtatcagagctataagatatagaaaacagtcttgtacatagagtgtggcatttcacatgagaccaagtgttctctgaatggaaacacacactaagagcaagatgtgaaaaaccattgtgtacaacctcatgtaaatgatcccttgcgtccgtacactatagtttcctcagtaactcaaaggtaaaacccaagtatcttgtgtctaagaggatcaaaatgtcaccttccttctgttttatttgttacatgcaggttttgtatagttttatagagtctttttatcactcatttgattttcataaaaattgggattgtttggaagaagagtcattaatattctttacagcttgttcttgttcctccttttatgttctctgctggtgcagacttctctcttatgtaaaatattccactgatgcccttggtagatttagaggttgttaaagaaattgtaataacagatcagggaacagtcagggactgcctgtcctatactgtctgaccctgactaaccgttctccttgtagttttaaatctttgtgtacagactgtaattcaaaaaacagtttttataaatttaaattcagcaaatctttccaaatgctaaggctttttataacgagggctagaaaagttgagttgtcagctattaatgccaatacctattaacaatggcaatgacattgaaatgattttttggatttatgaagggaacatgttactaatgaaaatagcaaatgaaaatggccactgtattagtccgttttcacgctgctgataaagacatacctgagatggggcaatttacaaaagagagagggtcattggacttaacagttccacgtggctggggaggcctcacaatcatggcagaaggcaaggaggagcaagtcacaacttacctggatggcagcaggcaaaaaaagagcttgtgcagagaaactcccgtttttaaaaccatcagatagtgtgagactcattcactatcacgagaacggcgcaggaaagaccaacccccataagtcaatcacctcccaccaggctcctcccacgacatgtgggaattgtgggagttataattcaagatgagatttgggtggggacacagccaaaccatatcagccacaaaggagagattaccctttttaaaaatctgtggtttgcccacaatgttttccataaatttacctttttctgtcaataaaaatgtttaggaattctatttatggatatgtatgtatttaatatttgcatatttagttcttattttttctctaaatggttatgacctgtactaagtaaaatcaaaacacacacacacacacacacacatacacattgtactagcagacctgctttaccttgcttgggataattatctgccatgattaaataaataaatttctgcaactgtttatcctggaatacactgcatagagttgtcagtttgagaagcaacttgatttcaaatctgagtctacaattttagcgtgtttccttgtgacttctagtttggggcttttaatttcccttttgctctctctaccctcagtttatgaacgagtgtggcatttcggcagttgaataggcctatggtagcctcccagtttctgtgttgtagaggatagttgccggcttattaaatgcccttgcaggactctcagggaagtctgttgtttagtgaatagtgatgaatcaatgtggatttcttagttttgacaagtgaaccatatggttatgtaagatgttaacattggggcagggtttctcaaccttggtgctactgatgctttggcccgaatcattctagttctttgttgtgggaagctgccctgtgtgctgctggatgttttgcagaatcctggcctctatctactaaatgctagtagcaccccctccccgccctccccctcccccccccccccccccccccgcccagttgtgacaaccaaaaatgtctcccgtaaaagataccaggatgaaatcactttttgtcagtcccaaactaactagagccagggcagcatgaaaggaggagggttcatggttacatgcctgagataaagactgtctcaaggactttctaaaatcgccccacaagaaattcctctgttaggactgcagcagtgcacgtaatatgctctcaaaagaacatctgcccagtaatggcatccccactaataaactgacaccagttctggcgttgagcatctgaaacgaactatgtttccaagcagcttatgtaaacttctgtttttaccaataaaagtttccctctacagtctcctcttcagatgcatcttgggttgtaatcctcatttctaattccaaaataaatttaacatatttggcgatgtttttctctgatgttttttggtcgacactccaaacattgttatatttcctctggggtacggcatcatttccggttgagaaccaccgacctagagaaaagctatctgcctgtgcagttcctttcaagggccccaagtgtgaattttgtgtatacctatattttaagccagatcattctgtacataccttctaagtccagatgaagtctgttagccttttatgtgtgataccatcacatagaaaccaacacaaggacatttactgtaatcgataaaggaaattttggacagtttgagaaagtaacttattttgtcttctgctctttataaaatctttacaagtgtatgtttttgctcttcaggatgactaggcagctttttaaaattctgacttcatacagattttataatcttccttttatttcttgcgatcatattgcagttgaattcccacccactgttcaattcagcagattttaacagagactccagaagtatagttcctgtctttaattaatctgcaatttaggaaagaaattaaggaggtatcgttctgtattgtttccaggatggtggtttcttgttatctgagaattactgggcacagtctcttgcccaatgtttacttctctatatagagttgacccttgaaaaacatagatttgaactgtgtgggtccacttataagtggatcgttttcaaccaaatgcgtatcgaaaatgcagtactcaagagatgtgaaacctgcggatatgcgttcagctgggcctactgtgggacttgcgtatgcgtggattttgctgtatctcaacagcaaaatccccgtgggagtggggctgcggcgggccaggaagcaacccctagcatatactgagggatgactgtactaattattgtagtttattaagtgttcacatggttttcacaaacctcacaattgaaatgccaattgccttctcctaaaaaatacaatgtacgtgttcatggtagctgggatgcagggcttgctgagaaatacttaattgcatttcttctgtagccatgaattgattttattaccttgagagaaaaatgagtattcaggtggacctcctggcaggcggttggcccttcagtgtccaaggatttatagaaagcacaacatcaaagaaatccaaaagttcttcggaaccccagcaactctcctacctccaaacttgccatgtaatgcccttttaaacttattatattgataggtaaatcggtttgctagaaattccagatattgagaattctttgtctgtgtaccttgttatatttgtataaaggtgatatttgtatgaagccaccctccagtgtgctgtaacagagcaatagtaatgacaactgattccttcccctagcttttctgttatggatagttgctggcaggtgaggaccaacagaaaaagaggagaaacccaacataattccaaactgtgaccatcataatggaaggagctgtgatagctttgctttctgtgtgtgcatgacatagaaggggaaaatggagttattgccaaaacaacagcaaaagcaaaacaaagccaacaaacaaaacaaaacccagggctaaatgacctttccaagagattttgcttgcatggcttgaaactggtgtttagagatgaggacaaggtcacccttgatactgagaggggattatatctgagacttatatgtatctcaacaaataatggtacttacaaagattatctcagtccagtgaatgccatcatacttatcttttgaccttaataacttcctgctattccaatctatccctatatatttttttctggaatgatcgaaatgtaattttagctgggtttaattctagttctgttaggtctttacagaagcttgcctggcttttaattctttccttcttcattgccagacaaaaggagagggaatataccactaggatacagagtagtttgtcataaaaatgaaagattgaaacagaatgagaacgtgaatccccgtaccttgtcttcagtctgtcagttggcgtaggtgagcagttttaaaagagccaacatgatggatcttgcatcttaggggctagaaatttgagaatgttcaacctttaagcatagaagaatctatagttttttgaaagagtagaacattctacagcctcccttggtaattcacactaatgctttaacaactttcagcatcaggaaattcttccatatgagctacagcctaaattcttcatgctgcttaagtctgtttcttcttgttctgtcctcagtggagagatcgaacagctggtcacaggcccctatgcgagagccattcacataattgaaaactgttattaaatcgccccttcagaagtcactcttgcttgttctctctctctctctctctctctctctctctctctctctctctctctctctctctctctctctctctctctgagaatctgggaagattccagagctgattaacatgttgctttactgatgaccttctcagcttttaatatgttaacgtgctctaagaattttaagaggcagatataatgtgcactgtttctttcattaatttgaccttctcgtgaagcattttgctggacgattgatctgctggacatactgggaaacactgactcagagattttagttgagtaggaaccgtgtgtgagcctacggtacagaacaaaagaaagtaatccagttacactgtctggagaaatagaggtacattctccgcaatcatatttgaagaatagttttctaaatgacaatggcaaactaagccgtgtcatatgaagaagaagtaaaaagaataggaatgaagaggcatggacagataagacagctctggtaaaatatttaaagggctgttcaaagaccaagaacttctgggttgctggtcagatggataataataatgacaataacaatagcaaacatgattcttgctatgtgtcagacacggttccaattgcctttcatttgctgactcacgtaatcataaaataactctatgaggtaggcactattaatatttccagtttgtagcagagaaaaagtaagacacagagagataaagttattttcctaaggtcacacagccagtgagtggtgaactccagtggtttaactctggaacttctatatgctgtgctgatggatttcagctcaatgtgatgcagcacttttgacaggggtatctggacacaggtgttcaggatcaccttctaaggatgtttcccagctctctcacatgggtggtgtagtggctgtaagcacacactggcatgggtaagagtttggactcgatgaatgctgagtttggactcagtgaatcctgaaagtcttacagctctgtggtgccatgccaaaaggatgaatggacttgcatgatctttttcatttttagattgcataattctttataaacttttttttccacaaagtacctctgtgatggaactctacacagagaaaagtgctcagcaacagctttttaaaatttaacttgtaagttcaggggtacctgtctaggtttcttatgaggtaaacttgtgtcatgggggtttgttgtacagattattttgtcacccaagtattaagcctaatacccattagttattttcctgatcttctccctcctcccaccctccatcctctgataagccacagtgtgtgtttttcccctctatctgcccatgtgttctcatcatttaactcccacttataagtgaaaacatgcaatacttggttttctgttcctgcattagtttgctaaggataatggcctccagctccatccatgttcctgcaaagaacatgatctcattcttttttctggctccggagtattccagggtgtatatgtaccacgttttctttattcagtcttccattggtgggcatttagattgattctaggtctttggtaaacagtagcatttgatcggaagtttgaactgataccattttgcagctaggaaatccaaagttaaacagtttattatagtgttgctaaatttagaattaggggtaatgactggagtgctgttgaggtgatcagtgttataagccaaatgacctgtcagtctaaaccctcctgcctttctatctgaaatgtggatatgtcctttattaggaaaccacattacaagagaagcaacttggctttgcagctcaaatacccatgacttgtgtgatactaagtattcccatgtcatatattcaactgaaattggctgtggaataagtaatgcttcttggttcttggcaaaagcaaaggagaatcatctctggagaaagcacttttattctaggctcaagcttttatttatctctagaaaatattggtaaggtcagtttagtacgtggtaaaaaaaaaaaacaaaaaacatattaagcacacaagaaatcaaggtggaaaaagaaagaaatcaaggtgaatgagaaccagaagaaatagcaaaccatagaagcagacctacgataacatcatattccagaattattagacagattattttcttaattgtgtttatgcagttagaaaaataaaaaacaacattgaaaaatatctacagggaaccacaaacctgagaagttaccttaaaaatgaccaagtagtatttctagatgtcaaaagtacaataatcaaaatttaaaactgtatgggtttacagcagaccggcaagagaaatggatacccagacagtaaggcagaaggaattaataagaatgaagcacagaaggatgttttaaaaagatgtggggcagagaggggggaactagggaagtcctgttcagagaaatatagattgaagaagagtaacatttatgtaacagagttctgaaagtagaatggagagggaatggagaagaggcactatttgttgagagaatgacggagaagattccacagctgattaaagactctaaatcacaggtttaagaagtccagtgaatcctaagcagtctaaatcaaatcctagaaacagcacaagatagaaaacagatagattatctttattttttttattttatttttattatactttaagttttagggtacatgtgcacaatgtgcaggttagttacatatgtatacatgtgccatgctggtgtgctgcacccactaactcgtcatctagcattaggtatatctcctaatgctatccctcccccctccccccaccccacaacagtccccagagtgtgatgttccccttcctatgtccatgtgttctcattgttccattcccacctatgagtgagaacatgcggtgtttggttttttgtccttgcgatagtttactgagaatgatgatttccaatttcatccatgtccctacaaaggacatgaactcatccttttttatggctgcatagtattccatggtgtatatgtgccacattttcttaatccagtctatcattgttgggcatttgggttggttccaagtctttgctattgtgaatagtgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgttttttgcaaaggagcaacagtcatctttactattgacttctcagcagcaacagagatagacgaaagtggagtaatatttcagtattcaaaaacaaaataaaaacaagaccccaaaacctttcaatcaaaaattttatacttgggccaggcgcagtggctcacgcctgttatcccagcactttgggaggccgaggcgggtggatcattttaagtcaggagttcgagacctgcctagtcaacatggtgaaaccccatctctactaaaaatacaaaaagtagccgggtggggtggcgtgtgcccatggtcccagctacttgggaggctgaggcatgagaatcacttgaacccaggaggcggagattgcaggagccgagatcacgccactgcactccagcctgggcaatagagatagagtcagtctcaaaaaaaaaaaaaattgtatttaatgaagataactatcaggaatatggattttttttttaaaaaaaggaggtattttcagacaaacagagcttgagaaatgcaccaccaacagctaaaggaaattctaagggacatatttcaggcagaactaatcccagatggaagatttgagatgaaagaaagcaatgaagagcaaaaaagtagtcaatatataggtcaatctatctaataatataaaaaattaaaacaatcctatagggttgaaaaaaacaaggtataattaaaattcatgaatatagtaacatataaatcaaatggtggtattttgagattgttgagatcattgtcctgtctgggatgaattgtatttcttacatttagactttgaaagagagagaaatagagaggcagacagaatcaacagggcatcatgaaaacagcgctaagccaggaggtttggattctattatcagctctgctgctagctgtatggcctttgaaaagctccttttctggtctacaaaatcagtttgcttgtctgttagatgaggctttggaaccagatgaattttaaagcccctcattatgattctatgagaaacagattctctagaaaaaaaaatcagttgtccccctcctttgaaattttatcagtaaacacctgcatttcacttctggctaacttttatgtatcagttcaaaaattaaagctaaataaagtctcgctcaggtgtgtagtttgcttacctttctcgtttgttggttttgttttcttttcttgtcatctagtagccaaaaagagtaatggcagtttaccaaagccttaggagtgggtagctctttggatatcagggagcatttgcagaaacaagctgtgaaaagccagcctagctttgcaaccattgttctttctatcttttctgtttaacttattaatcgaactgatatacacctcctttgccatcttgccttctttcctttcatccttttgccctccttctctctccctcctgtctttgcaggctaataataagccagagatcgaagcggccctcttcctagactggatgagactggaaccccagtccatggtgtggctgcccgtcctgcacagagtggctgctgcagaaactgccaagcatcaggccaaatgtaacatctgcaaagagtgtccaatcattggattcaggtattaggaaccaaaaaaaaaatgtcatttttttctcatcatttttcacctttttatgacttgatcttttatctcctgtgccagttgctgttagttcgtaccgtctccaaagtgggagagaaggtgattgggctggaacatcgatcattcctgtcaccctcctgatcgctaggttattttggtggatctcacttattaggctggtgtcccttaccaccttcactcttcagctcttcggagccacatttttggttgagcaggccaaagtgcgtgtcttcacggaggtattacagatgaactgtacctcctccttcctggaaccaaaacatttttaccatctttcctttttcacggtctttcctgtttatagaaacttcccaagaatcagttataaaactgagagatgattctattctgggaggaaccataatagtagctcagtctctcattcactttgcaccatttttttttctcccttaagtaacaagaattgttttcagcatcttagaacttgcttctttatctgtgaatctgattacattctttgtatagtatcccagtgaacttctaaaggaataaaaagtaggcaagtaaatggaagattcacaaagcagctaaaaaacaaccagtccttatacatttagaagtgaaagagataggaaacgtagcaggttattctgatagtcttaaaatatcatggaaaacaaggccaaataaatctttagccctgctgacctgtttggggagacaggatttttttttaaatgaattaatctcacttaacattaatcctaaatcctaattctgaaactgcgatgtccttaaatgtgtgaatcaacatcaaggtttctatagtgatgaataagccacaaagttgtaaactagctctatggtctatgcctgtgcagaatccacttagcagcaaagtaaacactcttttccagttacgtgtgaactggttttgttactttattttctaataactaccttgtactgttgcgtgctttttattcatagtgcttttttacttttggtgtttattgttccatagtcatgctgtttacaaagaggttttacaaaaacttttagaggtttctgaagcctagatagacaacagtgagtaggtactgcttgcaaaggtcaccttctttccttcccggtttcttggcaggtaaaaatgataccatgggggtggggagtggggaagggaagccacagtgactgcattagatttctaagctaccttttctctgcttccttagctagtgggctttgtatacaagggaaatttttataaaataaagaagaagaatgccttggaggatctgaaagagcactttcaccttcaattcttttgcccttatcatattatattattttaggacccagcacttctcattcctcctgtccccctcttgaaagatggctggaatctaaaaaagatagctttccttcccacttccccatatgtgacataagaaatatgtttatttgaattggctaaggttcttatctgagaaagcaaaaggcaggagagtatgaaacaaagaatatcgcattctgataatggaggaaatgtaccaactagtatttacagattataaattcttccatctaatccaaatttcatgttctcttggggcttcagttatcatttgtaggtaatggggtgagagatttctgaagagatagagataaaagagttcattcgagtaactgtttgaagatgaatcgtatcagtcaattagaaaacattattaaagcgagacttgttttaattgaaagttcttgttcacatttcttttgtcttgtgaaattgctttatcttgacaatgttttgaaaataattgcttcagaaaacttttgtcccatgatgggtaaggggcatgcacagcgtaagtctgtcgctcctggaagttcttttaaatttgagtatttggttttcaaaagactggaaattttccagtaccttcctacttaatctcaaagagttcctagtggagtttaaataaaagctgagtttttcttccctccttccatatgtttataggataatctttctgccaaaatgttttggtactgtaggagaggcaccggaaaaatctggaggcagaaagttaatcacttaccttgtgggactaatgaacattgctttctgtttctcaaattagaacgtggtagaaggtttattaaagagtgttctttgggaatttgattcgaagaaatacatacgtgtttgtttttgctctttatcaggtacaggagtctaaagcactttaattatgacatctgccaaagctgctttttttctggtcgagttgcaaaaggccataaaatgcactatcccatggtggaatattgcactccggtaagtttgacgccagcctgacgtgagagttagttcacctgggataaatttcagttttgtacaatactgcagatcatgtataatgctgtgatttgtcacttccccagatgttccccagctaaagtggctctcaactgtaggcttcaggatttaccctatccctggtgcctaggggagtgcctggcacatatggaacatgatagaccctcaataaatattgttggatgaataaatagggttttcattctgtgtgcatggttgtattgaagacgttttcacgtttattttgcacagccttagaggttgtgtggggcgatcttatggccatgaggcatgttgagtatgggggatggttctaggttcccccaaattcataaactaccacttttaatcaatgttgctcacctattatctgtcctgtatactagtgacattttaaaaatccattttatatgctaacacttactaaatgctaggcatttaccttttaaactaccctgtgtaaaataagtactatgatttttatcccctctatacagatgaggaccctgaggtcctgaggttaaataatttactcaaggttctataagtaagagttgaagccatctcctaagatgttattttaggaaaatgttaagtggccaatagaactgtgaaaaatcactagggaaatggcaaggatgtagacttggtggccagacagacctgagtacaaatctgcctaagaattaaagacaggctcctctcaggtttgttttttctaaaataaacctgtccctgttgactgtagagccacccttcgtgtttctcttctctttctttaattcttacagtctcctcttctctaaactttgcatgcttgctattcaagatacggtctgttgactaatcatcatatgtctattggcattaccttggtctttattagaaatgtgaaaccacaggccccaactcctgatgctctaaatcaaaacccacattttagcgagatctgcagctggttcccatacacaacaaagtatgagaagctctgctttagagcatctctctcttccatcatcagagtgatcctcccagatatttgcctgtctcacttttattcctcttatagagatggtcagtgattgagaatgtaccatgctatgaatagaccgaaatttagtgggtgaagcatgctatcattttgtactaagtagtttttaaaataccataaagtgtggtaaaatttaatgtcacctttttgaccttaagacctataaactaccatttattgagtagcctagtaagcttgtatgtttcttttatttatcataacaacgtgttgaggtgttgttgctcccattttactgatgatcagagcctctgagaagtaaataactcagccaaattagtacatgccaggcctggtttcagagccccatttgtctgattccaaagcctttgctcacaaccacaacactctccttaattacaaaacaagtgtcatggggcagaagactggagtggtcattagttttgaaatcatcctgtcctaaatctgatctcaccatgatctcccttttagactacatcaggagaagatgttcgagactttgccaaggtactaaaaaacaaatttcgaaccaaaaggtattttgcgaagcatccccgaatgggctacctgccagtgcagactgtcttagagggggacaacatggaaacgtgagtagtagcaaaagcagaacacactcttgtttgatgtatatttgaactcctctcagctgaacaccctccttcactcccaaatgcaaacagtctcttctatttctttctttttatttacattagctgaaaagagaaaaataagctgatgtccagttgccactttcccacgtcacttgacaatttctttttccaaaagttaaactttatctcacagggggaaaaaaaaaaaaaaaccacaacacaatacagccactaattgccttacaagccttataagaaatatgggactgtttacaaatgagtgattccagtatttcattttgattttcctctctcacaaatcagtaaatgtgtgtctttttgtatctcattgtgtggtcatatctagtcacttgtttctactcaaaagaaaatatagtcacaggaaactacttcacagtaagtagtaatgattctcaagatcaaaggggacgtcttcacctcttttcaacctgctcctcttttttgccttaactctgatggcagtcacacaactgtgtgtttttcttttaattcactttacaccttggtttggctattgctttccatggttcatacttaattggctggattttatttattttgacctttcagtaaatttttttgcggctgagtttgcgtgtgtctccttcaccacctcattttttgttttgcagtcccgttactctgatcaacttctggccagtagattctgcgtgagtactttttttgctgaagggtgctgctaccaccaacacattcgctcgcttggttctcttttgttctgtttatttgtttgttttcttttgttttgttttgttttatggacatattaattccccttccttcatttcagtttttttttttcttttcttgatgagactttgaaagtaccatctacacagatcaggagaatcagagtgggttttttggttcctccaccaggtgaaattcaaaccagcagaaatcctggcttgaattcaaattataatcaaagaagttattggagttttagctgtattcctgggagacatgtttatatatttcttcatataaaagcaaggaagaagcttctgattacataataacattctttagccatatttcttgagattcgatgctttttagaatctttagggtctgttataagtggactattaaaaatcagcagaattcgttttaaagtatgatgctgagtttggttgaataattttaatgaggtgtgcggactgtttatcaggttatgccatgctatttgactaatcattatatacaagggtttctaaattttgaactaaactcactttgctctcctctccaagctaaatattcagctcataaacaattatacatttgctctaggaggaaagtatttctttgttattactattggtgtgtattaataatactgagcttagataccagcagatgatttatctcagagtttataatgctagaaaactcttttttggggcctgtgatttctatattagcaaacaaagtgcctattttaaaactacattatgtagggttgttataacaaacttttggtatttcaaagtatgctttattaaaatatttattgaaaatcagacagctctgttatggataaaggggaaatgaccaattcggaagataagcttgtgtaagaattcaatttctttttattaaatcttttttattgttccaccatataatttaatctaaactagatccttttttaaaaaccctgtcgtgataaatgcatattattaattgaggtttattttcagtctttaataggcctaaaggaagtggaaggctatgctttcctttttaaaacttcgttattgcgccccttaattttgagatatggtagctataagtagtatattatctgatttatttaatcatcatgcttaaagaacttagggagttatttaggttcagttatgtcctctgcctcttggaaattgtgtttcctaacccaggtagtctgttatagaagttacaaccgttcataaataagaaacttttaaagagttgatacactacagtttcagcttgattggatcctgataagggaatggatttactctatgtggaaataagtttaaccgagtaagaaatccaaacgacaaatatgctaaagaacagttgttacaaatacatagataaaagtagcaccaaataataaacaaagagtaattaatagtccttgaaaggcaaaaaggagctacacgtaagctaatgagaaaaacattatgacaatcagattaacttattttaagtagaagattttgtctgtcttaaacgttgaaagactttaaaattaataacatcttttatttaaaaatattttctaacaactaaaacacacctcccaatttgcctttttatgaagagttggttagattattcagaaatagtgggaagttttaattttgaggaagaaaacaaatctagcagactgaagtctgtgttttctttaatagcagtaattgtatttaaagtatttattcataggattataaatactgtataaaatatattacaaagccatcctattcaggcataagagccaggtcctaacgtgtttcattttgcaagacttgtatctaatgttaacaaatcctatgatgattacaatatttgatccatttgatatggatcacagaatttgaaagtttccagagatacagaccgtttggttttccttagactaaactcttatttgcttgtgtttgtcatattactttaaaactaaagctaacataggcctttacgttgtctgtccataagtgagccagtcaaacgatattctttgagcgattctgcattgaaacctaaatgaatgtcagcttttaattaatagagttttcataaaagagaaggtggtggtgggtgggatggaattgaccaagtaggtcattaactcttatagtaagtaatccttctgggtatatggttttgtgtttaggaagtgggaagcggggaacagtattattaccttcttttggaagtgttttagaaggctttgcacttagttttgtttgtggactaagtggctttgtattttcactaattcttggtttttaaatgattcatctctgaccagtactcccttttggctcattttctggtttaataaatgtctcttttagtgtatattttttaagatttctggttattgtaagttcttgtgcttatgcatgctgtgataggcgccactgatattaataagaaaaataacatggaattatccttgaggcaaagaattaaagctctgtataagattttctgtataaaatggtattaaagtattttggatttatatgcctacttttcttggtgtacttatgctccaaggtcttaggctttcattcttgtacacacttccaggatagcaactattacaagggaaaacactactaatgtattttccctgatggtaggctttttgcttattaaaaaaatatgtaattgaaagactggtctgttccaaaagatagttcttataatacaaataatccaagtattaatttatcttgatctgcagtgaagatttcaaaacagaccttagcatttttctaataatgggctatgccagggttctagaagattaacagattaactctccaaaactatagtgaagtttcacatggaaatctttggatctgcttattaaattgagtagtcatcgttttgtttcctcttgacaatttaaacgtctttataactcatttcaatttgattatgattacacttgacctagatgacattggtttcataaataagacctttctctctcagggaagaattccatttccctagttatttgctatagtgtgtcgtaattatcttactgtagtatattaagaaatatgaatttctggcacattttctaatgcaagcttagctactggtaactgcatctttttcttttttaatgtaagaagaaacaaacacattctccttagtgtttcaaccaagtccttcaacgctacttggacactgggctaaaccagggtcctctctgaattacattatcgttgacttttggatttatgcctttacctaagggctttctgtgtcagcagagaaatggaagagaccttttgtgctattccaattaaaagaaaaagtccaagcctaaactggttttcagaacagatggttttttttcctaaggttaatccaaaagatactataaaaacttcaaggataattaatagatcagatatgaaaggatgaaaaaatgttaaccctaccagaattctagcctatggagataagaaaagataggtgtttatatacaaaaagcatatagactattcctgctaatgatctcctcttattttctcacctatgttttagcacacagtatctctaagaaatatttcagatatcatgacgttctatgaaatttagtcattcttttttaaaacctcacaatataatccagggtcattctattttgtgctagaaattagtggtatagtcttgctgctgaattggaagatacatttcttctttacaaaattgcatagatcaagacatcttgatacatggagttttaagaagtcttgtactagagtagcctctttgaagctaaaataattgtaagtatctaggcagatatacagctttgatccaataagaagatagcctataaatggcgcaggtgtaaactatttaaaattttaaaccacatagggctaacacaatttcggaattataggatgtgagaaattacaaagtaggaggacaaaatgcttcctagaaactgtctcccccaaccttttctacgatgggaattttccagagaagattttggcctctcttcatggcttttaataaaagcagaagtatgagaaatcatctctcaatcctggattttaaaatacttgataatatttaagatataggagcaactaaatgtatacattatccatagaattagaataaaagcattctaggccatgtgtataacataactgtgtggtgggttttttctccattaatggatggtatctgtgactaatcacattttctgccttataggcctgcctcgtcccctcagctttcacacgatgatactcattcacgcattgaacattatgctagcaggtatgagactagttgtatgccaggcaaatattgattgaaataactaaccaaggaaagctaacctatgatattttaaacaaatcttttctttttttccccaaacttgtctgattcctactaatcaacttgccctctaacgtgcatgccgttccactgcatgttgtttttggtcaccaacaagagcattagtccagaataatcttccctaaccctggcttttaaacatttccggtagccttgctatgtttttttatactgagcacatttactaaattggcttacaaatagtttaacctccttagaaaactgctagaccagacattcatatatgaaaaaatgatactatattatatggagaatatgaaagcatcagctttccgtttgtgtatttattttacatgatatgctgtaaagaagagaataattaattttcctaatccttggacttttctgtctcaccttctttgtgtttgagatgatttttatacctaaaaactgaattactaattttaaaatattttatgcttgttaaatccgtaagagtttggttaacttttttagttgtaaaaaaacaaacaaacaaacaaacaaaaaaccccctgtataattgcctgaggtgaagaagattttaaaggtaaaaattggtggcagaatgtttagagagcttactgtgcatccatcctttgtcaatattctaactgctggacatgtttaccaatcgtgaaaagcattagctagctgtgtaagtctgtcatcagtggaaagtagtaattgtcctaaaagacaaggggtagtgtaaggtagggagtgcacttattgttagggaagcttttcttctgaaaacaaagacctgttctcagtgaaagcaagactgatctgtagggggaaaacagtgaaatataactttccttagaatttctatcataaatgtagtgctactaactagctgtggtctaccacacactgcctcaaatggttaagccaacacacacatcctttaatttgaaggattcctttctcttcttgccatgatttatcctttagttttcaggaatgttcgattaggtcttgaatagattctaagacgtcacataagttttaatgagcttttacgttttttatcaggctagcagaaatggaaaacagcaatggatcttatctaaatgatagcatctctcctaatgagagcatgtaagtatcccatctctttttacaaaatgttcctgacaatgaaattgctttgagggatttagaggtaggatagcacaggatataggaattagcatcatattcatttgatcttttaaggagccattcatttacttttttcctttaattcttaatgccctggcatggaatgagctcatccaaattctggcattattagtattcagagtagcaaaaatagtttgccttactcttatttgaacttatttcataccatatgattacaaattgcagagtcccaagtatttatagtaatgcttaatctttgaccaaacctgccagatatttaaagggataggatattaattttaaagtcatggctaagtactattttctccactcatggggagtggaaacgtgatcttggtatagcatggctattcacatatggtaggttagttgggcattttccttcagaaatccaaagaagtagatttttgtgatttagcatcttcacaagataaataaagtgaggcaatcttatgaagagtttccagaggagaagtaccaattcaggttgcaggttgttagcaggatgataagccaaccctgttaaactttaaggacggagatagagcggtgctaagagcagcagggaacacagctatggcagggaaacaggcttcattatagagtgagggcagtgttcacaatacagagcacaaaggaacattgccatgaaccaagtaaatgctgaccggggcttgaggtagagagagcagacattgaagcaaatatgaaggaaaaaataaggatttgccaagtgaataaataacataaagagaagaaatctagtcaaagtattacgatgcctttttagtttgataaagtaaggatatctcacccatcttggagaatatagacaaagggaagaatggtaaatttatcatatgtagttggtgtggcaacacaaagtcatgctcagatgagaaaagaaccttcataaggattaggccaaaagaaatagtatcaaagtggcatatatataactagttattgaagacatgagaataaataatctcatctggtacataaacgatcaagctaataataaagaatcaagtcaaccctcagtcatttgtatatgacttacttccttcaaacaaacaaacaaaaaagcctttccccaaccataactgtgatgccttatctttcttagctatgggaaaaagtattaatggtactaatatataagatacttcaacagtaaaatgtgtggccaaagaatcagccaaatgtaaatagcttgtgcttctttggctcactgattttggtattagaagctctagcacattcagattaattcgagttgtatctacgtaacagtggctgtcattcattgactgcctaagagaacaggaagaaaagtgtagttacaactctaggttataattaaacatgggaagttctagcagtacaacttcagaatttggaatgagtgtgataaattaggtggtaaaactgcttttgttttattttaaaataagctttagcttattctgaggacataaaatccattttgactcaatgttggatggcaaaaactcatggcattttaggggcaggtttggggaagtggtttggtggattggttgacttcacttaaatgtgtgtttttaatacccaataattatttttagtcagcttttcacatctaaaccaggtaactggcttgataaacaaaaataattcaaatgagaaggactttttcctaaatttctgatatttttcaacttaagtgggtatggagaggagaatattagcgtatcatcttaatgatatctaaccagaaacaatgagctttagcctgtcattacggacagaagaaaattcttataacttggaggtaaacaggcctttccggagcttggagcaatgcattcagaaaaaagtttgtcctgtgtattagagagttcctagtttccaggaaagattgtagctgcctccccaaatagaagcctttttgcctccttttcccgcaagattagtccttaaaaccattatgtataaatttaaaaataaataaaacttgtatttaaaaaaactctgccccgaggaatgagatgttcagtcttcttttaatcagtcaccttaatgtcttttttccccttaattttcgttcttctgtctaaacaataactgaatgaaacaatcatgtatctccagtttaattgttgttgtcattctgcctcaatgacttatataagttaaaactgacttactgaagcaatactttttggttacattgccttccacttaataaaatatttcctctgttacttttagagctgcaaggtattttttcctactcagtacaacaatagcgtgggttagtgaacagattatcttgacaggcttggtggccaaagcattatacagccattattatatcttttaatattttttagctattgactaacatcaacgtagagtcccagtatttctgtaattctgcctttcatttatccgtgtaaataggccaatcaatttcatttgaaaatctgagcaagaaaacactttgaattggtaccagtagaatggtagatcacaacctcagcagtatcaaaaggtctttagaagcaggaaaaaaggtctaattaattgttaagagcaaataaatgtttctattttcaaatacactcctgagtccctaacccccaaagcaaaataagggggggaaaaaaccaaaacctttgattttattttccagagatgatgaacatttgttaatccagcattactgccaaagtttgaaccaggactcccccctgagccagcctcgtagtcctgcccagatcttgatttccttagagagtgaggaaagaggggagctagagagaatcctagcagatcttgaggaagaaaacaggtgagttttctttctagctttgtcattggtatgcagagtgcatacacttgcacacatagaaaagtgccaggaatcttcacttagagtcattttatgtctaattgttttctaaaataatctgtttagctccatttgcagattctctctctcttttttttttttgttatctgaaagaagacaatggatgcaatagtatgatgaagaactcatattttaggtgtgaaggagttaatgctgatggtggtatttgacttgttgcatgtgtctccaaggctttgattttatatttcagaatagaatttaagaaaaaagtaggttatttaattttatgattatatgattttttttacatgtgtttggccatattatctacctcaaacatttaagaaagtagggttattggcttggtcatattgggaaaccaattgtttcatcttatttttcatcatcaaatgcagaaattattatttatgctcaccatcatagcaggttagtgagacaattccaattgtcagccatcacctgtaaaagacagtcatgtaaaaatagcagaaattgtagaagagaaaaaggctaaagaactctcataatgactgcagggaggacaaagatgtaaacatctggggtactgtattgtgtcaggataatgcaaatcattggactttcagttctgtattacatttattatgtcacaggtcccttggtttaaaaagtcttctcacatgatcacttctaactcacaatgtgccttcttcagacagatgccaccaagcaaggatttaaagtagatgttgctcagatttgtgggtcttaagtactttcatctctttggttgagcccaaggcaccaaaagctcttaacgtaggcaacgcagtgtgtctgagatcagtgccctcgggagtatgccacttcaggatgaaaaaacaaactgccactcttccattgcttcctgctgccactgcgagccttctagctcttaacaccttttacctatggccatagctccttatctggttggcttccctttagtctctttcccacccttgcaataaatcctccatactgactctacttgtacatcttgccagaaccaagacccatcatggcattcccctttcactggatttctgcatgtagaaaaaaatcaagcttcttagtggggcgttcaaacccttccacaatattctcttgacttgctttttctatgccatcttcttttgttctccctgtgttctggctatgctgttgtagctagtatttctgaatacatcctgctctcatctacctttggggtcaagctcaagcttgagtctcagcctaactgctaacctctaacccaccactgccgtatctgacaaaggaatcccacctatcctccatcacactgctcaaaataactttccccatggagccctgctagatccctgcagttggaagaaatctgtcttttgcctctattcccagagcactttggacctttctcagaaaattccttgacagttttcctttttatcagttattaccagtgcctctctttaatgagctagtgtgtgtctttggggcatggactgtatcttaatcatcttcatatcctccagagtacttagcatggtttgaatatttaatggctactcaggaaatgtttgctaaaaacctgaaaatacagcaagaacatcacatgagtaccatccacgagataatattgaactttttttgttgttttaatgatagctttatttttggccgtacttttgagatcatttgtcagtgaagaccatggtagagaaaacatttctactttattgagaataatcagtaatatccatttatgttaaatctgtaattattgtaggggtcaaagtcaaatcggaataaaaagttggaactgacactgtaaatagaatttgatgttaccaaggagtaaatatatttttgaagtatatgatcgtgtaatatatcttttgagctcattggtcaagagccctgcctcgtttgtggttagcatagtctttctccgtaccattgcacccgggtcaaagaatgtttgtaaagagtactgataactatcatttatttatcattttatcattttgagtgcacttttacatattttagatcatttaatcttcttacaaacgctatggagaagagactgtcgcctttctgtgaatgagacacaggttcttagaggttcacacagcttgccccagatttcccagtcagccagtggtagaactgaattgaaatccagatttttctgactctaaataggcaactctgccttcaaccagataataaagaagagtaagtctctgtgaatgtcatttacatagaattgcggcatattccccagaatgtgccttaacttgagggactatctatgaggactgagtgtcccggaataaacctgttcatctacttgtggcacagcgataaccgctttaccctggaagatatccaagaccattctccaagaatgggatggtttgttctctaaaagaacaaaaaacataacaccaggcctacttagagctccaaaatgaggactctggggttgatgcaaatctttgtgtaagttaccttgaccttcacgaaatgatcaggatgagcttccttcattgtcccttcattttgtcctatttgaccttctaccaaattccaaagaaatgtctccacagagttcccttcctgaaaacagcccgtgtgttttctttgatctgccctgtcctgtcttcttgcagttctgcgcaaggagcttcagagccctagatttgccttcgctacccttgaattcagtgttgcttaaggagcctttaatttgccatttcctgttgagaaaacccaggaattctttagatgccctctctgtgcatgtctagctggctatgtcctaagtcagcattgggctacgcaatctgacaaatacgagcatacttttagagaaaataagaaagtatatttaaaattgagattgccccaagtcctttggatgtgtacttattgatctgttaatatatatattttatgttcctttagctgtgatttatctccaaataacagcaaaagagagaggcctggagagccccattcctgactagatatttattaaattccattaattgttcttattcatgacacctccctacaaccccctagaaaaacagaggatggctgtttgagaagtgtctcagaggtatcttatctctgcctttagaattccatttctcctggttgttgcacatagtattcaataaatatttgttgaatgcattaatgaataaatgaattgaagctgaatttattttaattgtagcatacatgcatgcacttttgactaaagttcttttacaaacctaatttcgtagagaaaagcctttcaaagactttgttttctgcttgcttttcaaaattctcccctttttcaaactgccttgattagcaccaggcatggctttgtcataaatttagaatgttaagaacccgttttccaaatcacaggcactgtatgtatcccacattggtgttctctgattcttggttgatgccacagagataaggctaaagctctgagtaaaagctaaatctgactgagtttttcccatagtgcctcccataagtttggatgactaatggtgttagtgagatatctaatctttaatatttcgcttctgcatcatatttctccctcattaccacatataattcagatacatctttatttggcaaagagccactggatcttgggtttttgccccattgtgtgtccttagcattgcagactcaaggtttacttttttttcttgcgttgattaaagccttcagtctcctgacttaagcctgtagtgttcaaatacagagatgtatttgtctctgcactgtctaaataaaccaagacttgctctgaaattcaaggtatgatcctagcaatgaaaaggtagcctttctgagagacaaagacattgtcgttctactacctgcagagcaaattgattagattgttctcaagtcaacaaggtggctaaatattaacctaattcaccataaagtctaaagttaaagttgttagtagatgttatataacacgagggaactctgtagattcttaatacctactcaggacctttcatatgtcttgttgggcagtaagaccttatgaagccaaaatttgagttttctctttttcctttaaattcctccagtgattgtgcaagattattattgttacagtcaaagaagttctagatcagttactgataccactgaattaaagtagctggaaatcatgatcccgttgctttactttgtaattgacttgatgactttggacctagtctagtagctatcaatcttcatagctacgggaaatctttattcaatgttctttcattaggtctttgtgcaagtctccaatgatggtgaaaagatggccaaaatgaagggaatctgaagaggttaggaatgggcattcctatggaatataaacaaaggtgtcagggtgaggaatggcagagtttgtttgagggaaactgcagttgtattaccttttttaagaaggcaaagaatgagaggagatgaggctgaccaggtcagcaagggcaggtcgggaagggtgtggtacccactgcagagttgctgcctccgtgcctagtctagggagcaactcaagggtgtgatccaggagtcaggccatgatattgacatgaatatacgccacacaggcagctgtgcggagggtaactttgaaaagagcgatgctggaacgaggaaatcaagctggggggagtcacatgggagcccaggaaagagatgattagagccttaagtaaggtgatagaaatgaagtagacaggctgatctgagtgatatttcgggggaggatagagctgtttgattcggtagttctgtgggactagggtatgaaggaatgattcccagggctggtaactacaaaacaagatgatagtagttatttgcagctgggactgataattcaggaggagttgcagcaggtccatcctttaatgcagcagtgtttattagaggtccttcctgaagggctgagtagctggaaggtgataaatgaggtatggaagaggtcgagttgaggtcctggtgacatctccatgtgtaaatgtctgacagtctgagagatagaactctgatgcttgtagaaaggatataagcctgagatattaggactgtgagtcgccagctcacaggtggtagttgaaaccgtgagaatgaatttatatatcccgggagcatgtagcagaaggagaacactggatttggtagaactccggaagatgtgaacattaaagtgtgtatttaattacttttatttttagtagagaatacatgtatattattatacaaaatccaaagggttcaaaaagacatatagagaaaagtgaatccttctccaaccttctcccctggctgtggtgtttccagctctggaggctgccatctttcttggtttcttgtgtttccttccaaacatgctctctacatatgcaaatatttgcaaacatatttatggttgttggggttacttcacacagtgtcgtgcagtgttcactctggttttctctttttacttaaaaatctctaattttcacatgctggagaaatgtgccagaagaagaggagggcagagcttgggaatgatgggagcattttcccacaggaggcaggagagagaagggttagggaactaaagtatgggaggaggcgtgaccttgaatgagaggaaggactgcctctgaagacaaagtggtaggtaaggaatttagggtaaggaagggaggaaagaagcataatggaatgaatgttaaaatgtccagtagacatcactggaaataattcaagactgattcctacggctgttcccacatgtttttaaagttggagtggagaggaaagcgtggtatatgatacatttaacgaaactaggcattcaagttacttggtgtattagtccattttcatacggggcaatttacaaagaaaaagaggtttaatggactcacagttccgtgtggctgggaaggcctcacaatcatggcagaaggtgaaggaggaggaaaggcatgtcttacacggtggcaggcaagagagcatgtgcaggagaactgccctttttaaaaccatcagatctcatgagagttactatcacaaaaacagcatgggaaaaccccacccccatgattcagttacctcccactgggttcctcccatgatatgtgcggattatgagagctataattcaagatcagatttgggtggagatccagccaaactatatcatttggtgacatgggccccaaaacaaagggctacagagcccttcttgagacaaagggagctagtttgatcacagaaatcagaaagccaagaccttttatggcaaggatgaataagagctgaagggcatacatgccacatttaagaagctgtgtaagaatggggtcaaccatctcagctctactcaggcagggaggacaggaacatggtagaagtggaatcaccattattcacagactcagtttctaactagcagggccagtgtaactaaatttccttcagtttatccaaagttaattgaagtctgaggggactgattcatagtatgcagttcatggcagtgaatggataacccagaatgaaagtttatttctccctttatcctaattatctctctttttaactgccttgtattaaaatgttatcaaggttgccttaaagcttttttaggaggagacagcatctggtttaagtgcaaatactagatctattaaaatgaggaatatattcattttttcggcacacagcatcctgtgtcttagaatccagtgtcttaggaatcacaataaaaatcaaattgtgttctggtgagcctagaatcttggcatctaaaattggatgtttgtgaggactgcttcatactacaaaaaaattgaagcacccctctggcgattagaatattcacatcttacaagtacagctgccatctccctagaacatgctggataagagtttatgttcttacaatccaatttcccttttttttttttttttttttttagatttttcatgaagaccctcatcctcctgttggccttcatttgccaattgtccctctacagtagaattgattatggtcatgagtttctttagctactttccaggcctgaggatgtaattctgttcaattctgcagatagttactgagtgcttaatgtaattttaaaattatgagactacaaagatgaataagccttggttcttaccctcatggagctcaaaatttattttaaaaaagttaaaatagaaacaactacttatatcctactgttacaagtgctctgggggcacagaggtgaatgatttattctatcagagggagtagagaggcctttacaaagagagtttaagagttgaagactgaatgggagttttccagtctgagagatgggggaaggatgagttttccagactggtggaccagtgagtaatgtgtggcttggaatgaggagaataagagggcagtgggatggtaggtggggactactgtttaaaggactttgtgcatcatactaaggagtttgggttttatcctataagcaggtgaacagtgatggctttttgacgggggggaggattgagaaaaataactgacctggcagaaagctaaagccatgaagattggtagaagcacagtggaatagtccattaaaagatgccaggttcttaactaaggatgtcttaggcaagtgaagaaggggatggagaaattagaaggtcactgaatgaatgagaccaagggaaaatggagagggggaggcatctggtgttacggaaagttttaatttgggaactgggaaatgatcattgaaaaacaaacaaaagcaacctagtgcacccaggaaaaactcctgatttgcaaagggttagtgcatggagagaaagagctacgtatcagacatactgaattctatttgcccaaggacatttcaagtggaaatttcctatgttgattttacgtattcagttttcagaaaggattctttaaaaagtcatagcaatacaattcctgcaatataaataatagatcaatgaacatcatagggattagcatagttgatttgactaagcttcagattcagtttgagcttccctgtagccagggagataataggaaacaaagatttgtctgtctcttaatattgaattaaagaagcacgcagcatcctaaagaaacatcattgttttcctggctctacgtaataataataataacaaaaatagctgtcctttgagtgattgctatggacaggaactgttctgagtacatatgaactcctatttaatccttaaaacaaccctatgaaagagaggctgtttccagaggattacgtggcacagagtattaaggacacttcatatggccagcaagtaataggacctgtattcaaacttgggtggtggtcctgaactcttaagcagcgttacacttgaagtgattattggctagtgtccttatcaacatttttataacaaatcccaagggaaattatatgtggctgtttctcatggcctttgataattgtggaaagcttaacattaaaacaccaaagatagggtgacagttctccaaggataaaggtcactgttgcctaaaatgtattctgcagaataccactgagatactctgagaaaaaaaggattccaaggacagtaaaactttgaaagcactcatactggaaagtcatcattacgttagcatttgcactgaggagtttggaagtgaagaaacctgattagctttgtctaacctcatgttgctcccacttacttgacctcgagcccaactgcaatgttatatggaacacactttggtaaagaaattcaagtctgaagtaaactttgaaaaccagtctaggagatagcatagttgactctctactgtagttgttgagaagcctatccgttgtgtctctgggaacatcagaagataaagctataacaggtgcccacgtaggaagcctggatttttcgcacaaaagtaacttttcatatgctctagtggtgaagcagttaccctgtagacccagaagccagaatgatttagtctgaaaaatctaaagataggtattaaattaactctcatgatcatagaaaattctttgcaccatttttgtagaatatcccaccgaataacttggcttttcacccaaaccaccaagaaaaattgccaccagtgacttgatgcaattaacttgctatcgggagttctttcttgtgaaatgattgaactttgaaagatgtttaccaaagacagcacctttagcttcatcacaattactgtggaatctttctttgtaagtagttagatgcaaaggccagttgttgcttgaggcctctcctggattgtgattttaaagtgtatcatcaacacatgggaagatatttctccctctttatcttatgacagaaatgcaggtatagctttcatctcaaagtaagattaaggtataagttacaaagatgtgtagctactatatggtcctgtgtaatgctacttgaggaaggctgttcctttcctggcactgaaattttagagcttgcataatcagtatatcaacctcgtgtggcttggtgcttagcaagtttcagcttctagagcccatggctaatggagccatccaggagaatgttggagagataggtctgaagccttagaagagaagtcttgattaaggagtaatgagttgcgggaaggggtcatggttgtggcggagatggaagcctggggagaggacagagacctcctaggaagagagtttgtgtaagaagaagaccaaggacctcctgatgtacttgattgtaattgggcatgagcagcccagttagaaatggtttcctgttggtattacatatgtacatggatggcttctgcagatggctaaactcacccattttatttttttactatcttaatagttaaaatatgaccttttcttgtgtctccaaattctgagttaccttatggtgctagtctgtctgttgtaactacaagtcataagtaaatccatatgattcttttcctgtaatttcctggtaaatcaaggcgataatttcaaagataaaaatctgtatttttagctttagcagtgagcatgattcccagtctttttgccttcgagtaaggtttgtttccatggtggaagtaaacaatatcccacactctagaatgtgagctcttcaagggtaagggacagtgtcctacatatatctttatctccacagcactgggtacataaatgtgtcataaaaatgaatgggtaaatatcctttggagtttttctgttacttgatgggtttttggggttgattttcaggtatctcccttgtttttctcatttcttacattattttctttcccaaaatcccttaatatacctgtttagtttgtgatgtcattttccattagactgaaaccatccaagttgtttaggctaacccagacttaagcattttctgggcttatttttggactctttttaaaactcatcatctgaaaatatttaatgtccacacggataattctgaagacatgtgcataccatttttcttttatgtacatgggttaaaccttgatttttccatagtaggagaaagcattataagattttattgttttcactggggtaatatcttttgtgctataagaaataaaattttgaatctagaacttagttttttataagacctttattgagatataattctcgtaccataggagttacccatttacagtgtattagtcactgattattagttaataggttaaccagtattagtaatcactggttattaattacagagttgtgcaaccatcagcgcacaattttagaacatttttatcaccccccaaaagaaatcccatccccattttcaagtcactcctcgtttctcctgcaactactcttttcagccctagcagtagacaatccctgatctactttctgtctctatggatttgcttattctggactgttaatgtaaatgaaataatacaatataaagtcttttgtgactggcttctttcacatagcgtaatcttttaaaatggtatctatattatagcccgtattagtatttcattctttctttaatgctgagtaacatttcattgtatggatataccacattttttaatctattcattacttgatggacatttgggctatttctacttattgtctgttatggataatgcagctatgaacattcatgtacaagtaccggtaattattttaaagaagttattctgggctgggcatggtggctcacacctgtaaacccaacactttggcaggctgaggtgggaggatcacttgagaccaagaatttgagaccagcctgggcaacatggggagataccgtctctacaatttttttttttaattagccaggcatggtggctcatgcctgtagtcccaactactcaagaggctggggctggaggatcacttgagcccaggaattcaaggttacagtgagctatgattacaccactgcactccagcctgggtgacagagcaaggccctgtctcaaaaaaagaaaaaaaaaaaaaagattctatagtttctgtcattgtaatagaggaggccataggatcatatatggcaagagtatatagcagtgcatgccagggagtgaaaaataggccatcaaattgaagttactgggagaacttaagactaagtctaactacgcatgagggattgaagccgggacacacaaagcttaaaattatgattcttctagagactgttacggctttttgctgaccacagacaatgaaagtttgatattttgctgtatttgtctgaaaatggaaacacacttttcccaatggcagtattcctgaggactagagttcttcacctctaaaacctctccaatcctagtttttccttttggctgatgatgaccagccactgccatttttgtcttaggttttgttagtctgtcttatttccagttataagtggttaaaatttcttatgaattcttcttgtgttgaacttttgattaatacatttagtctatagacagtaatgaattagcatctgatcaggaatttgtgaaaaacatctcagtcattaaagattaagaaactgaagccaattaatattgtcatgttctgtctcttggaacttgagcaagatacagatctacgtgtcaatgacatatccagaaaatagactccacctagatacattaaccctgtacccttggtccacatattttatttcagcaatgatccatggacatattataatttgacagtttcatcacatacctagcgtattgggtcaaatcaaggaaatctcatcctagtgatcttaactcagtgatttcattttgcccagatgttcagctgtgataaactttactaaggcacagatgatggatgatacacaataattccaaaatttgggggtggctacaatgtggctaggggctagaactcaggtatctacaggacaaatactgagtgattagtcactttctaagcgctagatatgcatatgttctgccaagctcagtaggtctaagtagattgcttccatttcagataattaagtgctttctttttataggaagtttttagcacatctgaggttctaaatccaaaaagtaaataatatatagagaaagaagtaataacaataataatagtaaccaacatttattgaacacagtatgggctgggcatggttcaaagaaagtttgacatatagaatgtcgaccatactggcttaataatcctcataactgaattagtgcttaagtcagttgcccagcctcagcaagcagcagaggcaagtaagtcataaatcaagatcttctgaatccaagaccatctctcaagccttgttctaattctctcctcagccatggatggtgaaaggcaccacaaaggcagcgtgtcaaaaagtggcattgttcaacctttcccctgatggggcaaagcttttatttttttcctttacgttctttgacatctgttttaaaatgcagatatcactagaagaaatgacaactttattataaaatcccagtaaaatgtaaatgtcttatataaaacctttatactgagcaaatttcagtaggaaagggcttggaagtaaggctctgaatgttttaaagggggacagtgctaagaaatgattagaaacaagagcctggaggggtcctgccatttttactgttttgcttaaggctgacctaaaatatgcatagtcttacttctcaccctgtgagcttatccttattaatgtctttttccacctagtttaggggtatttttgaatttgtgtttgataaagatgtctaaagctgtactgtaaaattttattgtcacttttttttttaaatggagtctccctctgttacccagcttggagtgcagtggcatgatcatggctcactgcagcctcaacctcccagactcaagcggtcctcccaccccagcctcctcctcctgagtagctgagactacaggcatgtgtcacgacatatggctaatttttttcaatttttttgtaaagatggtgggggtgtctccctatgttgcccaggctggtcttgaactcctgagctcaagtgatcctcccacctcaacctcccaaagtgctgggattacaggtgtgagccattgcactgagctttattgtaatttcaagggctcaatgcaatttccagtttttaaagttcatcttgcttgcagaatttgtctttcatttaaaaaaaaactgctgattggctacatttatagctgctgtaatagttctgtatgatttactacatttgcctgaatttagattggtggatatgatttagctgcttttaatattatatgagggtaaagccagatttctttggatctattccttttagatggcaatctttgtagttgttctactttacaaaataatccctgtgtgtgctcatgctttggtatacagttaaatgtatgatactgttaagaaaacattgatcactggaaagtgaccttcatttctttatttcataaatatcattatacaactatataactacacgtagtagggaagctccatttaaagagtagatgacttacactgaaatcatttgacctttgtaaattagtttaaattacacagagattgttgtaatgttctttatcatacataatagttacgattgctagagaggcactcataaatcattgctaaaagggccagctgctttcatgttttcagcaggttgagttaagggaacaagccttgccaatttgattaatctcttatgtccattagttggttgggaagtttttttgagtgtaaatttgtatgtagacaacagagtttatattctttatgacataaaattaatcagatatatctacatatttgtagaatggggggattcttagctctatagagaataagaaatactggatggaagactttttttaggatgactggctacaggaagaaattgtagtgacagaagccatgtgtattgaatttgaattaatgttccttagggagctaccagagaaatataatttacaagataatcaagaacgtaaatagattctctgtggagtcgttgtctgatcactgacatatattcatctgtattgaaatgacttcatgactacattctaacaattagagaatcattaggggtgagatgtacgtgtataccttcaagaaaagcaaaatatgtattggtaataattgacagctgttaaaacgagtgcattgtgtacttgttaaacattagaggctgggcatgttggctcacacctgtaatcccagcactttgggaggccgaggcaggcggatcacgaggtcaggagatggagaccatcctggctaacacggtgaaaccctgtctctactaaaaatacaaaaaaaaaaagccgggcgtggtggcgggcacctgtagtcccagtgactctggaggctgaggcaggagaatgtgaacccaggaggcagagcttgcagtgagctgagatcgcaccactgcactccagcatgggcgacagagcgagattccgtctcaaaaaataaaaaataaaaaaataaaaaaaaaacattagaataacttaccttggaacagtaactctgagggaaccttgatcatttatgagaatgatctcccctacgttaatactgcatcaaaactaacattatggtatacctcaaaaagtattggcatagatgtttttaaatataagaaaattcaaatgcgtaattgataagggctaaatggctcaatttcccaacccctaacaaaaatatgccctaacacagctctgtgactatgactgcatttattagaaaacatttagtaaaaatcatctctagttcaaaccctccagcatcagttcttcttgataattctcatgaacatttagaaataccttaaaagagaattcagactcaaatcaaaaaaccttatttcatttggttgcaggccaagatacctcttttaaccatttctggcttttagaatccttatcatgacagcttgtcctatctcagagcttcaggaggaaaaactagtccctcaaaatcaagtttgctattgagcttaataagaggtttctgtatgtcatatgtttgtttagaagaaaagcacttgttcgactcatttaatcctggcctgatgaattaaggcttgaattaatactgagggaaccttgactatacatctacaaaatcaatgtgtcctggtaggcttctgattaagataacattagctcttgcttgaaggcatctttctctgctcctaccatttatccagtggtagataatatatggagtgaaaaatgaaaaagacatagctgggctttaaagcaagatgaacatctctgtgaaccagaaatgtgaaagaaaaaaaaaaaagtaagtggggctaaattagtgggctttcagctcgtgctgtagtaacagggattaaaattctccttacaaggtagtggcccaaagccaggattactatttgaaatcagagccccacaaaaacacacctagagagagacacatacacacttacacttaaaagcaacatgaaaagaaacagtttgctgcaagggtctacagcttatatgcagctatggccctaatgcatagagccgagggaagaggcaaagattcgcagttgggaaagagagcatcacagccttgaaaccaggacctgaaccaatctacctactgcctggcaatgaaatgagtgatatctctgtatcactcagtgtaggagctgcaaactaccaacagatgtggctctaaactctaagcccctgggtatggctgggagaagccataaaaccacctgagagagagataatgagtttaaaaagagaggaaaatattaaagtacacacacatgagaataatagaaaacatacacatgcatatgtatgcacatgcaaaacatcccttgcaaaatttgtctccaaatcacgatccaaaatacatgaagaaatgggatagcaccccccacccaagttaaacatcaaaaagtgaattaggctgggaacagtggctcacacctgtaatcctatcactttgggaggccaaggtgggaggactgcttgtgcccaggtgtttgagactagccagggcaatgtagtgaggtgccatctttacaaaaaataatttaaaatatattagccaggagtggtggtacatgcctgtagtcccaactactcaggaggctgagataggaggatcgcttgagcccaggaggatgaggctgcattgagccataattgtgccactgcactccatcctgggcaacagagtgagaccctatctcaaaaaaaaaaaaagatgaattaattctagaagaaagcaaaataatacactagtacaacaaagatttttacttacatttaagatgctcagaccaggtgcagtggctcacgcctgtaatcccagcactctgggaggctgagatgggtggatcacctgaggtcaggagttcaagaacagcctgcccaacatggtgaaaccctgcctctactaaaaatacaaaaattagctgggcatggtggcaggcacctgtaatcccagctactcaggaggctgaggcaggagagtcgcttgaacccaggaggtggtggttgcagtgagcggagatcgtgccactgcaccccagcctccatctcaaaaaaaaaaaaaaagatgcttaaaggcataaataaggggtaccactcgctaaaataacaagaaactaagaaacagagatggatgaaatgtaactaggtctgaaaacaaagatatctttgccaaaaaaactagtcattgaagttactaaactcaatatacaggataaattctagactttgtcctgtcagagaaggcaagggaattagaagatgatgctgagaatgttactgtgtacaacactcacagaaaaagataagaaatataaatgagcaattaggagaaatggagaattgaccacaggctctacaatataccttactagaatttagaggtttgtttaggagtgtatttgagaggtttcagaagaaaatggaggaaatggtagagaagtaatatttgaagctgtcatagctgagaatcttccagaattgaagaaggatgtgagtcttgaaggaaatgtgctcccaagagaaatttcaaacatctgggaaggaaagaaaggcctgcattgagcaattgatattctttacagctcagctttggctgattaaaatgagccttttctgttttcactggaaaccaccaaaacagaaatgtaatgtgttgtatataccaaaccatgcctcttgaacaagggtccttataaataaatcataaaagaagagccctgtggacaactaaacccacaggatcaagataccaaggaagatctctctagaaaaggcagtctcctgtcagcacctttgtgaaaaataggtgggaagacagtaatggcttgttgtaccatcttgaggtccatgtctaaaaactgttttcaaaaggaacaccatggctgccccaatctggtagaaagaaaaatttgaataggattctacataaaaagtgttgccagttagaacattttgttgaagttttcttttaatgaagagggaaaaatagaaagtaattcctatggaatgagaccttgtgaacattggatactgcttcaagttcacagaaacattgaactgattgccagttaagttctcagaaattagatttaattaatgtggacagttacatacatcggtgcacacccagaagacccgtgtgcagaatctgactgaaggtgtacttacttcgatgaatctcttctcatcactgctttgtcaaagcagattgctatgaaataaactatacaaacaactacccttgaaggctgatagcaataggatttcaatcagtacagataggagattctatttctgtagatgaaaaagatcatacattgattttctgtgtgactttaaataaattcctggaaaccttgtaatgttaggtactaggtagaatgaaaaaaatgaagcaaaacaaaacaaagaaaaaaaccagagtagattgggttttctttctgcttccatgtggagatctagccttttgaaactgagcattttggaagacatgccgtcccctgtggaatgttcattccgagtatgggacaacagaaaatatttagcagacctggtgatgagatgatcttgctttctcaaactggacaatgggaaaactcttcttggctactcactacttacatttcatctcttttctcattgatatagatctcccacatttgtggataggaatttctctcacctgatgaaatatcatctgtgaacaacagaaatctgtcatcttattttggtatttatcacaagtagaagaaagatgtcaagagttctaatcagtcactggatatcaaatatcagaaatgtcctcaattggaattgtattctcagtaaatcctaaagcatttgggaccttcacatgtgctaatactgtttatatttatttggaaattaaccaaatataaccaaaagacagtggaataaccatagaaacctttaaatggaataaaatttatggcaatcaacattattaggaagaaaaagtatactacctagaaacagtgcaagaacaacgaggatcttctgtgcatctaactatataggtctagaaatatataaagtgaattatgatagaattaaaaggagaaactaacaaatccataattatatctcaacactcatctaacaaaaattgatagctacaaataatcaaaaattaataaagatatggacaattttaacaacaaaatcagcacactatgtatttagagactccatctttccaatggaaaaatacacattatttcaagtactcaatgaacatttttagaaagtgactgtgaactaggtcacaaaaagaagtattgctaaatttcaaaggatcagtatcatacaggggttctctgattgaaacgcaattaaattagaaatgcactaagaagtgaaaatggaaatataaccactgtgctcctaaatgactatgggttaagttaaaagaaatcacagtaagaattacaaaacataaggcactgaattgaatcaggtgatgtatataaaaacttttggtatataattaaagtggtaccaaggaggaaatgtataaccctaaatgtgttcattaaaaataaaaaatcaatgacttattcaacctgtaaagcaagaggaaaaaaaagagtaacaagtaaaacattattaatggacataaaatgagaccatagtaagtaaggagcttcactgcattcttggatgtgaagactcaattattatgaacttagttcttcccagtttaacctatgaattcaatgtaattcaaactcaaaatttcaacaagcattttcataaaatcagaaaaccaaacactaaaatcatggagaagatcaaaggggtcagaatagtcaagacaattttgaggaaaaacaaagtgggctgagaaggcctatcagacatcaattgatttaaagctggagtgtgggatctaccagggatatgcagatagaaccacagactagaatacagagctcagaagcacacctgtatatttatggacacttgatgttttgcggaagcatcgttagagatcagtgggaaatagatggaccatacaatgaatgaggctggcttcatagtttatccatgggggaaaagtaaaattagatcgcatgttcacggcaagcacaaaaatagattctgggtaaattcaagtcctaaatgtgaaaaaccaaattttaaactttaaaatgtaggtgtaagaaaagattttcgtgaacaaaacataaaaagcagagaacatacagggatatgttaaaatttacatcttttataccataggatgccataagcaaagttaaagataagctacactaagataagggtagaagatcatatttgccatgcacataactaacaatggattagcatctagaacatatccaaaggtttaaaaagaaaaagacaatccagcaggaaaatgggtaaaggaagcatgaaaagccagttaacatggaagaagtctaaccttgccagtaatccgggatgtatgtgcaaattaaaatgcacccatcaggttaactaaaacttgaatgtctgataacaccaagtatttggtgaggaggtgggccaaatggaaaacctcattcactactgaagcgagagtaaattggtaaaagcaccgatttgtcacccagagcgattcggtgacatgtagcaatgttgaagatgttgctaagatccaacaattccacatcaaactatattctgtaaagaatctcttcaacaggtatccaaggagataggtataaaaaagaatttcattgtatcattgtttataatagtgaaaagttggaaacaacctaaatgtccatggacaggaaaatgttggcatattcaagcaacagaataataataccttatggcagttaaaatagcaaactattatgtatcgacctggagaaatctccaaaatggtgttgaaggcaaaaagcaactcttagaatggtatgtatattcttaaatgtgaagttcttaaatttaaagtttaaaaacatgcaaaataatgttattagattgaatcacataaaatgggtgtttttgtaggtgaaagaaaaatacaggcaaacatcagcatcttttttaagctcaacctagtatttgttgatacattcatggtaacactgggcatgaaattcagtgtggcattatctccttgagggcagcggggaggagagaatggtatggtgttgaggcgggcatgtgagggagcttctgctttggctgttaacttttctttcttcaaaaaacttttgaagaaaatatggcaaatgataaacttatcaaggggaggtgataggaacatgggtatacttactccattcttatacatttctgttgaaaatatttgctaatgtttagagcaaaccaaagtgttgatagaggtataaaatttttaatctcatgacattataaagaaatatttacaaagtgattaaatcctttgctgcttacttatctgaacataccagtcgcgaggcttttagtgtaacataaaaaattgaaaagcatggctcccttcacacaccaggcaaaagcttcaaattttgttttgttcttttagcactggtaagattgtcatcattaaaaccattcattagtgcctcttttgcttgctgttcttcggtggcagtcagatgcatctatctaccatggtatataaaatttggtgatgatattcaaattactttttttcttctttttctttttctttctttttttttcttttttacttttttgatgccaataggaatctgcaagcagaatatgaccgtctaaagcagcagcacgaacataaaggcctgtccccactgccgtcccctcctgaaatgatgcccacctctccccagagtccccgggatgctgagctcattgctgaggccaagctactgcgtcaacacaaaggccgcctggaagccaggatgcaaatcctggaagaccacaataaacagctggagtcacagttacacaggctaaggcagctgctggagcaagtgaggagagagatgggatttttacaaacattcatttttccctcttaaacaaaactaaacctcagagagcactttttataggtgcaacaagcatcaattcttaagtgcttggtatgtgcctgcaaagtgatagtatcaaaggatagaagtagaggagatagaaaaactagtgtgtcttttttgtatttgtccaatattgtttcctaccaaaatggttttttcttgaccaatttgaaatacatcttggggaaaaaaacgcctaaaggtttccactagttctctaaaagtgaatatttcacttcttgaaatggaactatttcatttacaattagttatattttctggtatacctttgtgttttttttctcctaatccctaacacatagttctttaagcctccatcgaaaacctagcaagatactgcattgtaagaggacctacctggacatagttctggctttctgggaattttaaatttttcaattatgttctctctatcttgttacttaatacttcacaaagatatgaatcttccattacagttttgagatctcacatagtctcatcattcacacatgaccttctaaatcttccagttatttaatgtaatgatgtatagtctcattccagtgtagctctgatttttttctcaaatttataagggagcacaattcagatacaaagacagtttctatggattatatcaacagtgaaatatcccaaattaaacaatctttgggagggcttctaaagtaggaagggtcaaaatttatgagtcctgagtgtgtatcatattttgaaatttatacatttgtatgtttattatgaaaagtaattctgttttcttttggatgacttagccccaggcagaggccaaagtgaatggcacaacggtgtcctctccttctacctctctacagaggtccgacagcagtcagcctatgctgctccgagtggttggcagtcaaacttcggactccatgggtaagtgtcctagctactctcagattttgttgtctgaagaaaggtagagtcgtattacagggacatgaatatttggccgtaagtgtttgactcatcttggtatcagggagccactgaaaatcatataccaggcgaaaaaagtctaaaaagaaaattctaaaaaggtgtattctggcagctctatctggcccacagaaaacttgtataggtgagaagaccagttaggaggcaattgccaaggccaagattggtgagttctgagggcctgcacttgagagatgtgggaggagaggactgtgagactattctataaaaatagacttgccagggggctgggcgtggaggctcacgcctgtaatcccagcactttgggagggtgaggtgggcggatcacaaggttaggagttgaagaccagcccggccaatatggtgaaaccctgtctctactaaaaatagaaaaattagccaggcatggtggtgggcgcctatagtcccagctactcgggaggatgaggcaggagaatcgcttgagcccaggaggcggaggttgcagtgagccaagatggcaccattgcactccagcctgggcgacagagcaagactgtgtctcaaaaaaaaaaaaaaaaaatagagttcccagggtctggggactgagtgcaaattgtaagaagaggaatgaagggagaggatttggttggaagaagatagtgaaacttctgattgtggacataatgtgtttgagaaattgacaggtcttctaagtcatgtcccaaaagaaattaagatacagatctatacttgaagtaagtgggcaaactggagagatttgagaatgagtttcatagaattgattgctgaagggtgtgagatgagaaatctataaaatctataacacaggtgcttcgatccagtgccttggaaaagacctccatttgggtaatgggatagtaaaggatggataagtagggaggttcaaggaagatgtgacaaaaaggtgaaatgctaaagagagctcaatggaaattaaaataaatcacagtccattgggtcactataaatgcattgggtaattttgagaaaccattttaggccaagagaagggaaggtggaaaacttctgtttcaatgaaatgaaagactaggtaatcttaaaatgaatgaggattaaggaaagtgaagacaattttgaaacattaccaagtaagaaggaagccttaggcaaaagttggatgaatttgttgaggaaatggtccacatgttctgttctcattcttagcaatgttctctgcctaggactaggttctaagaaaggtggagctgatgaggcataaatgatcaaaggtcaaaacaagagtagggcattttacagtggtaatgaatggctaggacaggggttcctagccagctgctcattggtttttcctgctgtgtctggctagacaatagagggttttatgaaggccacaaatacttggtcccccttcctcatttctctttctctgtaaaggcccagtaggagtcagctccatcctctctccttacttttccctgggacctaaactggttatatacttggtcctctcaaatcttacctcacagaatagaaaagacctgtgactccttgattccatacacttacagctctattgcctgatatgatgatgtgttcaggaattcatttcatacttgagctcttccatgagggtagaataaagggaggcaaagtgccttaaccaaaatggataggacagaaaggaaaagtcaggggtgtgggtgagttttatggcgaaaaatttggagatcacagtcgggaaaattcaaaagttggatatcatggaagtaaaatactttcaagcaatttctacatctaacatggtgcctcccagcgagctgctgaagattttacttggagatcactgaggggtagggagtacagttcatggagttgatgagaccaacgttgctgagcttatcagcagaggggtgaggtccagatcctgacgacagtggtagatcaggatggaaaagatgttgaagaagatggacgagggctctgaggagatgaacatttctgaggaaagagacagggtagttgaaataaatgtgatgaagttcaagaacctggagcagtgggaagaggcacatcctcctctggagaagccaaatcttgtaggaaagccaggttttgatttttttgagaaggaaaaggatatgtttgaggttattttcctgaatttactacacctccatgatttaaggcaatctctgtgtcagattatctccctccacctgagatctgaatatagctaataaactgttgggattgtaaatgacaacacactacatgaaaaacaactgtatgcatttgcaaagtctgtaaattctgaaaacaactgagctttagtacctcttatttttttctacttcaggattttcccccttttttaagtaagtaaagcatatgaaactaagttacatattttagtggtcagattcagagccctgggtgcttagaagcattaataattatttaggtcgttgacaatggcgaataggcagcatactcgttaaagcactcaaattaaagtgcacattaggatgtggtcctgatgatctgtggagctaaaaagatcatggtagaactgaataccaggacaaaagtgctatattccaatggctaagctaagagataacttgctggcataaaatggataagctgtgttaaatttgtcctctgaaagaaaagactgaattcaagggtactttttcttgaactgtgtattaatctgttttcacactgctataaagaactacctgagactgggtaatttatgaagaaagaggtttattgactcagttccacaaggctggggaggcctcaggaaacttacaatcatgggggaaggtgaaggggaagcaaggcatgtgctacatagcggcaggagagagaaagcgaggggagaactgccacacttttaaaccatcagatcttatgcgaactcactatcatgagaacagcatgggggaaaccgccgccatgatccagtcacctcccaccggacccctcccgcagcacatggggattacaattcaacatgagatttggatggggacacagaaccaaaccatatcgaactgcataagctaacttcatttaaaaaggaaaaaagccttaccgtcttcttgaaggatgcacacaggtgtttaaataaatgcagtgtatatacttgggctttgaaggtttgagatacaaggctgggatctgctgaaccacattctggatagagctgcattctttaaatatgcaaccccgatgactgattttcttttaagtgaaacatgagacaagtcatattaggtgatgtgtctaaagagtcaacatatttcctcaagccatgaaatacttatcactgagtctctatgtaccatttgtattctgtacagttcttactgagacaatgtgctaatgaaacgtacattctattggaggaagcaaatacagaacaaaatagcaattaacaatgtttatcccctattggctctcatgggctccatatacaaatctgtgatgtccagacaactccttatctctgatgactcctaactttccaccagattactgttttttgaagcattttatattttattgatttaaaaattaaactgttcctttgctttttaaaaaatttatcatgtacatttgaggtttatgacataatggctccctagctttttatttagaacaatttcaaacttatggcaaaactgcaattaattcaacagtttgccacatttgctttatagctatttatttatgtacttttacattcatgtgttgttaaatggattgcatatatttagattaacatgtatatctgtatgttaacatatttttatatactgtatatgtttatattttatgtgcatatttaatcatattcatgcgtgtatatagtttgtggatttttttttcactgatccactcaatggttaggtttcatacataacacttcacccctaaacacttgaacacgtgccttctaaaatgaaagatattcttgcataagcacaattatcatgctcaaaaagaacaatactgttatataatgtagaatttaaattcaaatacctccaattctgccaattaatattcttcatagcgatattttacattcaggatcagtgatgtccctgtagtctcctttaatctgaagcactttcccagcctctttaaatctttcatgacattgatatattagaagaggtcgggctagatgttttgtagaatgtcccccaatttgaatttgtctgcttgtatccaagtgattgggttcgggttaaatgttttatgccagattaccatataggtaaggtatcctcagtacatcacatcaaggttttcctcaagattctccatccccttcaccgttcttcactctccctgggcgctccttccatactttggcttctgctatgctgacaactcttaagtcaagatttccagcccagacctcccacctgagcatcttctggataaaattataaataaaaatatagcctaatctgaaatcatgatcaacctttggagcatctcttccaatttcccaatctatacaaagtcattttctaccccttcttcctttacctgccttccttagctatgttccaccaccatcaatccagtcaccaaggtcagtgtgttttgctacttatgaaaaagagcaaaattcttcaattcagctacttctgcccaaatttagccctcatcatgtgttacctgaacagacaatatgaatactttcctaattggttcctctgcctttggtctctctccctttctaagctatcttccagaaacttcagttcctcttctaccattcaaattatatcatattattcccctctttaagcattttatgccttctgtttgacaacagaataaatgtgctctttggccttgagtacattatgttcttaacctgaaatatagcatcctttcttttcactcagtgagttttcttttggaacttaatcatgcattatatcattctggttttgttgttgttgttgttgttgttgttgttgttgtttcttttgtgtgagacggagtctcgctttattgcccaggctggagtgcagtggtgcgatctcagctcattgcaacctccacctcctgggttcaagcgattctcctgcctcaccctcctgagtagctgggattacaggctcgccaccatgcctggctactttttcttgtatttttagtagagacagggtttcaccatgttggccaggctgttcttgaactcccaacctcaagcaatccacccgcctcagcctcccaaagtgctgggattaaaggcatgagccaccacacccagccatgttttcagccagttactagtacttctttcttctgcctacaactccctagaacttaagctccttaaggacaggatgtaagtcttgctcattgtcgttactgtatgaggatactctgtgcaacaaacaatcagtaaagtgcttgttgagttaatattttagaaatcaagcataatacattcttgtgtacacatggaacagcccacacgtttaggaaatttagctactagtttcagtatctttcaccaccattcacaactgatcagctaataatcagcaacaacattgtacaccataatatgttaaaggtgttacacacagaatttatgtgtgaaattgaaagcatcggtcctatatcatatggaaaaaaattaattgtagccaaatgttgggtattggatacatcagtgtgctttttcttctaaaaaatactggagaaaggcaggaaatacacaagtactaagataataacacatcaagtcggaaactggttaaaatccaaagaaaaatgttggtgggcgtatttgttcatacacagccccctttatgagaaaaaataatttcttgtacacagctcctttttaaaaaaaagagaaaataatttgtttagattcagacaaaaacacaggagtaattcttgtgtctattctgcataggctgcgtaggttctggctaaaatcactttttaagcagatagaaccattatcagcgtttgaatcaaagggaagtgagtcagatgggatatcttcccttcaagaaagggatctgaaaccatcgttatatttcagaagactgaagaatatcttgccatggcaaagcattccttttcttttttctcggattaaattgagtcatcccacttcttttttcttcacttcagcagtgattaaaggagactatcatattttgctatatcacggtactatttaactttgactatgtctttccttattttaaaaaatgtttcagtgatttatttggaccacaatcagacaagccaggaagaccaaatagctaataatccaaaaaacattatttttctctttttattatttcagtagttttcagggaacccaggtggtgtttggttacatgaataagttcttcggtggtgatttctgacatttgggtgcatccatcacctgagcagtgtacactgtacccaacgtgtagtcttttatccttcacccccctcccacccttccccccaagtccccagagtccatggtatcattctcatgcctttgcatccgcatagcttagctcccacttataagtgagaaagtacaatgtttggttgtctattcctgagttactttacttagagtaatggtctccaactccatccaggttgctgtgaatgccattatttcattcctttcatgactaatattccatggcgtgtgtgtgtgtgtgtgtgtgtgtgtgtgtgtgtatataaacaccacgtacatactgcattttctttatccactcgttggttgatgggcatttaagctagttccgtatttctgcaattatgaattgcgctgctataatcttggtatgcaagtatatttttcacataatgacttcctttcctttgggtagatatccagtagtgggactgctggatcaaatggtagttctacattttagttctttaaggagcctccatagtgttttccatagtggttgtcctagtttacattcccaccagcagtgtaaaagtgttctgttttcaccacatccacactgacatctattatttatgcatgtttgtggaaatcaccttggagtagagtcaagtttaagtgttaaagcattgccatcaactaagtttaaaatcccccaaagactagcaatatgctatttgagcaggcaatgaatctgtgaagtagggataagggctgtgcaggtctctagtgtgcaactggaactcagtattttcttgttgaataagtgaaaaaagtgaaaaggtgtttttgtttttggtgatgaggggcttgtgatgacaggtattattgttagagtcagaaatattttgaggttgcctattaatatggtttggctctgtgttcccacctaaatctcatctcaaattgtaatccccacgtgtcaggggagggacctgatgggaggtgactggatcatgaagaagttttcccccatgctgttctcgtgatagtgagtgagttctcaggagagctgatggtttttaaagtgtgtggcacttcccccttctctctctctctctctctctctctctctctctctctctctctctctctctctctctctctctcctgctgccatgtaagaggtgccttgcttcccctttgccttccaccatgattctaaacttataatcatgaggcctcctgaggcctcctcacgcatctggaactgtgagtcaattaaacctctttcctttataaattacccagtctcaggtagtatctctatagcagtgtgaaaatggattaatacacctattatgttgtagctacatagtgtatgattagacaagccataaatattatatctggcttgtttcatgcccataatagtgtatcagtcagctgttgctgcataacaaataaccacaaaattctcaagttgcatatttctcattcacgcatctgttgtttggctgaacttttgctggcaatcagctggacttgacaccaagttgtggtttgggttcaggtctgttcaacatgtctctcatccttcttgggctagcaagctacctgggccatatgcttcttgtgcacataaacacaagcgggcaaccccaaccagtcaaagacattctaagcctctacttttgtcatgcccgcttacattccattttccaaagcaggttatgtggccaaatccgaatccccaggccagggaagtactgttttcccagctcttgttcactctgctttatctacattagacttcttgctgtgcttgaggaagccagtcacactctcctctcagagtctttgcatttgccaatccttctgtctggagcacttttccctcaaatacttgtgcaactcataccctccagttcttaaagcttttgctcaactgcatctcatcaatgaggacttccaagactccactttctgatgactctcattgtcccttgctagccctctcctcagagtgttcatcaccactcaagatacctatatagtttacttatttacttgttaagcctgtgtgcctccttatgaatgcgagtttcacagagagagtgtgtgggtggggtttgtttgcttattgctatatcttcagtgaacaatatgccaggcactgttcaaccatttgaacagtgcctggcatatatagttggattttaataaatatttgaataaataaatgaatcttactgtttttaaacttttgtggtttttaaaaggcattttaaaaatctgggttagtatcaaatattacaatggtattactttaacttcaggtttcatttagctgttttaacttttacaatatattctgacacagaaaatattaggcattaagcatttttcaatgagttgattcacttctactcatgcacatatgtgatgtctgatttcgattcttaaaaagagatgagcctgggcgtggtggctcacgcctgtaatcccagcactttgggaggccgaggcaggtggatcacgaggtcaggagattgagactattctggctaacacggtgaaaccctgtctctactaaaaaatataaaaaattagccaggcgtggtggcacgcgcctgtagtcccagctactcaggaggctgaggcaggagaatcacttgaacccggaaggcagaggttgcagctagccgagattccaccactgcactccagcctgggtgacagagcaagactccatctcaaaaaaaaagaaaaagagaaaaaaagcaatgcattaaaaccatcttgagaaatcatgaaaatatggagaaaagaagaaaacaagattatactctacttgtttttatactacctagaatgtaataggcactcaaaaaaatgtctgaatggatacaattatcactgccttaaaagttttccattaaagcaaagaagccaattttacatttgtattatacttggacactcatattaaagactcacagagagtttatctggaaaaataaacttggctgacatcattaggtttatactttataatttgatctttgaaataattcaggaacaggaatgccagtcacttcattgaactgtacctgaattttaacacagtacaattgagttcctagagctccaatatgatgtaattaaactgtcagaaatattaacatcgatgttcatgagcgtcgttcatgatgttctcttggttctgatttattcagtgaggcatactgtcactgaagtggacttactgccattaaaaatgcctcatgtttcccagttccgcaaaaatttgcatcagtaatgaaacagagagatgtaatcagccctgcagttgtcaggatcttgatcctcttggtagtatttcattcatttcatcttcaccagataatggtagtttaaaaccgcaagaaaaatgaaactaaaaatagtgaatttcacttctttttctaaaggcataaacttaagcaaatagtgcatgtgtgtgaggggggaggaagagagagagaaagaggagagagagagtttgtaactattccttttctgctttgtgaccttaattcttcagcacccatttcctgtacttaatattgcaaagaggtttcctgtggtatgttaccaggagactcatgtagtctgaggctttttatctaccttacgttcttatccctccattctaataaaaatatgaagcctcacatccacctagaatatgattttgtcttaatggttagcattggcaatgattcttttagcttctgctgttaaaaaaaaaaaaaggaataaatgcaggattctaatcaaacatgaaaatccaagtggcatagaccaaagggaatgagaagcatatttaagtcatttagtcactggcttccgaagcagttccaagtcagatgtaaacctgaggttgtccctaattaagttcattatggttgacttgctaaagcaaggtcttgttttagatggaagtgacaatgtgcaaaacaaacagagcttgaatagaagttattttcactattggaagattgtatattatgaaaagttagtttcaaaggacctttaaagtttaattttgtttgcacctaagaaatttccctttaacttgcaaatgctgtttgaagtgtatttctttaacacatgaacaaacaatacagacacagattcacaaaatctacaaggagatttccattcccagtgaatatcatccatccataggtttctttgcttccagatcatcattctctcctcacataaacagtcaaaatgtttgtaatgtcttctttataaaacccaaaacataattatgataaagtagtcccaagtaacagaggaaaggaccataactctccaatatatgccatatctacagtttttagaatattcatatttcattacctatataggatatatactatttttatttctattacattggagtttaaaggtacttgagtttcgtttgtatttttggttaaatgtcaaaacaaagagtgaaaaaaagacctcagtgtctcaactcccttcttaccttcatgaagtgactgcaaagtgttcaattcttactcttttgtgttgaggagacagcactgcaagtgtgcagtaatacttattttattacatagaacaaagtttcacatttgtgaatggggcacaaaagagagcttgtcagttttacctttttcaattgactttttcttttattctttttaacttttaaatttattttttgtttttttgtttttttgtttttaaatagagacagggtctcactatgttgcccaagctgctctcaaattcctggcagcaaacaatcctcccacctcggcttcccaaagggctgggattacaggcatgagcgaccgcacccagcctgttttttactgtagtataatatttgtacatatttatggagtgcatttgatattttgttgcatacacagaatgtgttaatgatcaagtcagggtatttagagtattcattatctcatgtatttatcatttctatgtgcggggcacatttcaagtaactagtcaacttttaaaaagatacgcagtaggctgggcgtgttggctcacgcctgtaatcccagcactttgggaggctgaggtgggcagatcatgaggtcaggagttcgagaccagcctggccaatatggtgaaaccctgtctctactaaaaatacaaaaattagctggacgtgttggcgcatgcctgtagtcccagctactcgggaggctgaggcagaagaatcgtttgaacctgggaggcggaggttgcagtgagccaagatcgtgccactgcactccagcctgggtgacagagcaagactccatctcaaaaaaaaaaaaaaaaaaagatatacagtttttttttctccaagggtaatgatatagataaactactgtatggatttcttcttccctttaaagaattacttcctcattattaagcttgagggttttctttgttatttatgagcaagtgaaatgaatttataatggtgttaaaaatgtaatcatggccctttaatatctgttttctataaatgtaattttccattatttgtttttgcttttattaaggtgaggaagatcttctcagtcctccccaggacacaagcacagggttagaggaggtgatggagcaactcaacaactccttccctagttcaagaggtaagctccaatacctagaagggactcagatttgctgggatcaggccactcgcttccctacccaactggtgtgtgtattttccatatggaagccaacacgcagtatcagaatggcaatttgggtccatggtgaaaagatttgatttttaagtgtgaatttgtggtttagagtactctgaattcaaatacccgtgagggcaacatgtttccaaaaataagaataccaccctctatttgtcaagtattttacttgcttcacacattagtctgaagagttaattatgaggtgccctttactgaagagcaattattatgtgacttttacagatgaggaaattaatgccctgatagtgcctttgccagggacatatggctactacgtgctacagcaaggcctagaacaatgcctactgattggtagtggtagagattctgacttgccatctgatgccctttatatttaaaaattgtatcttactccatcatttaaatatagggacaattaaatcttcatagagtagttggttattttttacttcgatagaggaaatacaggcttagcaaagaaagacattaatatttttctttttcttcatcactttggccttgcgtattttacccccatacaaaaacagcattttaccctgcagaattttcccactggcttgcatgagcttcagatgtcttgcttcatccaagatgatgttttgctgctactgttcgtttctgggggcatttatttggtttattgccctcacataaaacaaagtcactctctcgccttccttcaacgaataaaaaggatggtggcagtcacctgtgatcaaatagaagaaaagcctagagaaacaaaagggagaaaacacaaggctttgtggccagtgattggcacctctaatgggtagcctgggagggacgggcagcaggaaatctgggctgtttgttcctctccataagggcaatgaggagggtgtattgagtagtgtgtttttcctatctttttgttcagtgtcagttaacaatggccatttcctagctatttgatgtgcaagtaaacgttgtgcagtgcacattaaaagcaataatgttctggtagagcgttgctaaggaaccgtcaggggaagctaattttaaatgtctgcaccagccatcttttcactgctgagcgccactgaagtgatgattttaacagataaaaatcttatctgtcttccacccacctccacatcccccaccgccacccgcatccccattctgactatcttaggtatctccttcttctagatgtcataattcataatgagaagatcatacacaggcttgacagaatcaggtgctttcacgtgtctcctcattactttgtcctgcttgcttttactagcacctactacgtaccagtggaggtagtagggatggaaagaagaaatgacaaattccttgccttcaaggtacttatggtcaattgcagatacagaactccaaagaaattcaaatcacagtacaatcattgattactgtatgatcctggccccttgaactggcagcttgcttacctgctctggaaagttgctggctgccctgttggcaccctgggcatttcttccacatctaaacaagaggttagtagagaagaagctacagcaaggctcatgactctgcttcttcataggcagccttgacttcctagactcctttttgtacctgagtttctggtccaccctaattagctgtaaggtgaaatcctttgcaccatctccctgtgtcccgcttttagagtccttaaagctagataccacatgggtgtagaagcttcctggaagacaagaaatatacctcctctgatatggtatttagcagtcagtatctctgatgttgatttacttacttgtatggaaacttgggaaactcaattcaggccacctggatagtgtttactaaattagtgcttacggaagaatttcaggccttaagggctgatttaagttctcaaatgtgggagaaggaagccttgtccgataccaattccattaacttaagttccggcttactcagtggtacccttgtggcctgagaaaataaattcacattcttaaaaaacaaaacaattaaatacacaaaaaacacaagagagtagctaaggtattggaaaatctggcctatcattctgtaataccatgatcttggcatttcctcacgttttgctactttcagctaactcaggctttcttacaggcctttttctccccaaattcaagtggataaaaagtttcattattgtaaaaattaggctaattattgatgcactcaaaaaagtggtttttggatgctttctttccaactaaaagcacttttgttttttaattttgaaaaatggcatatgtgtgtgtacacacacatataccgtcaagtttggcgggaacatcttaccagttggtagatgtgttcagctgatattaagcagaaattcttgagaatcttaacatcttgggattacaaagtctttcaaatggaagagccttgaaaggtcattttaacacttttgacatccaggacagtgatttctgactctgttttgatggttatccatatcagaggaacattttacatcacaaactggggtaaagatataaaataaattgtacatgtgtttatgtacacacatgtatatatacacccaccatatgtacacacacacatttacagtgtcatatgcatacaaagatcagaaacaaaagtttcatcaagtgatgccttccatactacatacagtgcatgctgtttttctattttatttatttaaaaacaaaatgctggttgcaacccactaaatggattttctgaaccagtggtttaaaaatactaatctatgtgatctcagtttttcttgcctggttgaattatctttcaaaaaaatttaaattttgagatttttgccgtggaagtttctgccaagacgttgctaatgtctcagagacctttatagttttattctaacactaccatccatgttctcattgttgtgttacaaaaaacaaagttcatgattgctacagctgttttggacagctgtttgagtaactcaaaacagatgtgagagccagaggtctgacatttagtggaaatgtgctattaaataccaccgcgtggtttacttaaccctgctagataattgcccacagaggaaaagccgtttttaaaaaacttatgctcttcataaacataaagtatatagataggtaagctattatgtacctcaaatttacaacttttctgttgccccttgccacagagttggtcctgaaggtgtcagctaacctttctttatcttttattttcacaaagagtacctggaagccaagaaaagtcaagtgccttatttatggccattcagcaggttaagttaggcttctaatcttatcttaatggctttgctaaactgttatcaaaattaataaatgagtggcatgcttctccatttagtgataaaccgatggccaacactatcctgcataataggcaatataagcaggagcatattcaagatatgaatgtgtaaacattcagctttgtgattatatctttctggttggtctctagatatacttagttgttcacaaacacttgggagatttgagtggctcagtgtatatttgaacactgaatattagccaatttctatctaatctgtctatctctaatctcttcctttgtaagtatatgtgtagaaattgaattatagtgtaataagtcattatctactttactataaggtactctctaaagctctgccattctataggaaaactacatgggtacaataaacaaacgtaatttaaaaaataaccccattaagtgatttgtccataagtctctgatcatttagcagactaacaaagatatttttatatgtatgtgcattgatgaaagaaacgctctcctagtcagtagtatggtattaggctctctaaaatgtggtaccactttatatagatgaatgaataataggagccaagataagctcttaatgcagtaaaacaatccagaaagcagttagcagtgctactatttctgctacctgtacaatctcttgcctactgacctgtgccacattatctccaccagcccatgccatcctctttttttcataccatcccctctcaaataagcccgcgtacattctatcaaatacccctaaattaccaacccaacagctttgtaaaacctaccgtcttttaaaattaaaatcttattctgtggttcttttatggaagagcaacataaagaacaaaggcagatagaaatatggtgtgccctttttcaggcaccattctgtttcctgtatgctcccacaaaggatttgagcggttatccctttaatccaggactagcaaactacatacagcccaaatgccaaatctggcccaatacctgtttttataaagctttattggaacacagccatacccattcatttacatgttgcctatagttgctttctcattaccagggcagagtagttgcagcagtgctgaatagctggtccagagaccgtgggcttgcaaagcctgaaatatttactatctggccctttatggggaaaatttgccaatccctgctttacgctattatttcgttgtccattctgactcattacatgtatagagtcacaggcttctgtgctgatcaactttcagctgaacaagattattgagctgaaattgaattgatttatagatttatattcatattcaccaaagagcctgcaagtgtggccatttgaatttttttgacttataaaataacagaaatcctaaaaagggacttattcttccttaagtattttaaatagtcagtgaattaatataaaagaggctaaaagcacccagaaacagtactgtcctgcaattccaactctaaaataatgaattacaatcaataatgtcaattttatagtgcccgaggaaattagacttctcgggacctgaccaagccctttatttagactcaggactgccccagcacacttcccttttgtcttgattcatttcctgacaacacatcacattgccagatggacactgtaactgaaggtctacagaaactcatttccaaaaaaaaataaatgtttagaaaatgaaacatatctgaaactttatttatcggtcaagaacttttaaaaatgttgtaatcaagtagcctctgttttgtcagcgtagaactagtccttttacagtagaaaatatcatttgtttttaactttttctaaagtgaaaaaaaggaccttccttttgtaatgtgttaatgagtacgtggggacccaagtgatgagggaggattttagaagagattagagttagcttggctctgggaggtccattttcataaaatatggtttctgaagaaggatctggaacataacacaagtcatttgctgctacatattaagaaataatcaattgataactgagttctgaatatggcttagtgtagaattactaaagatatgtatcattaagcattcaaagaatcatcgttacattctgaagtacataaccataattacattctaaatcacatggctttctaacaacactgtccttcctaaagatctcaagttttcaaaactagaccaaagttacatgccgaaacaagttacccacctttggcatccaaactaaagtgtgccagtgaagggcaagttacttataacacagaaggactcctcttggtcatgacccaactactactttaccaattcacttcagccagtatttatcaaataccaaaagtgtgtatatacggtacagggcattgggcatagagaggtggatgagcaacatgtggaccccgtcctcaagaggcttatagtcttacaggggaagggaattaattctgccaccagacagtattatgaaacataaagatacttttttaaaaaaaccttgctaaaggaatcaaaaagaaggggtgagtgattcatactgggatttcagccatcaaggaaagaatgatgttctcctccccaaatgatgggaacatcatttggtatggatctcccactagtgacacccacagctgaggagctagtacccatttttctccctcttttccctggcttgaggagcatcttaaatacctggcccttacgtggtcaagctgaaaatctgatactcctaagaaatcgctgagtcatgtaggaaattcagaaggaagagaggaagggagagaaggagaaagggagggaagaaagagaaggagagagggaagaaaaacttagaaactatccttaaatgtatactagaagttttgaaccctaaccttgagtgagttttgaaaggtttctattggtgtcgtagctccatacctcttcattccagactagtagttctcaaattgtttcagggagtttttagtcttcttggagccactgagaatgatgggtggaggggaaagggagatgctgtacaggatctctcacagctctgctttgaactgctcaaaatattggaattccatataagattgttttaggagatgtcccattgctatagttaaaacagtttgaaaaccaagattttaaaggaaattgcatgcccaagacaggctattgacatgtatggacagaagtccctacttttctgtccaattatgacttatcatagaacactttctcatcagagtctacttttgaaatacaaataaatgcatacagatgtaggaatctatgaatcaaggccagtgggtctttagccattgcctcgtaaggctcctgatatttgctgaattggggaggaagtggaaagctcattcctggatctggctctgtggcttgcccattactgggacttacctcttcccctcatctgttctttctgttttctcaaatgcctccaatttcatcatggaaatgctcagcttctatcagatagaacaaattctcccaagaggatggagtccagcctctatgtcgggttctaccttgcatttgatgtgcagactttgggcacacagagtcaactactgtttatgtttcaatgtgctgattgtcaagagtgaagagattctgagactttttttaacattaagtttgagttgtccttgaaaacaatgcccaatttgtcagatttctattctgtgccagttttcatccagtttaatgcgtgaactctatggattttacaaatgacgtcttctggatcatgttatctgtttacactgatcttaagtgtatgtaaaggttatttgactagatgtgtcttttgggttttttgtttctgtttttttttttttttttttttccagcagagaataaatggtcatctcaacatttgtttggtaaaagaagcaaattggtatgaaattgtatatttatgcatgttttttttccctttctgatatctctgcctcttcctctctctattattaaaggaagaaatacccctggaaagccaatgagagaggttagtgagattcaggctcacggccatggcttctgtctgtctcatcctgctttttatgtttggcgtttgtgtaagaattgtgtgtgtgcacgcgcatgtgtgtattacacattgtgtcatcatgtaaggatggtagtcacctctccacttgcagctcatgaggaacattcctcaaatgttcattgccgttgtcatcaccatgacgacaagactggggttgggagcaagaatctctttaaaatggcaatcctttgtagtccctaggttggaatcctgccgttcatcatctgttgccatttgcaacactaacaaaatcttcaaaataaatttagccttgaacataactgatgagtcataaagctttcttccacttccaggaccttagcattttctgccagcgcccttagtttttattcttctgggatgacttcattttgcttttgtttccttttttcttggttcctacgctctttctctcccattttagcgaacattttttgagcacttactgtgtgccaagcattgttctcagcacttgccatctttttcatcatgtcatcttcatgacaaacctgtgaggtaggtactcttattaaccccgttttacagataaggagactgagtcaatgagagagtaagcagtgtgtcccaggtgacagagccaaggatttggatccaggcagtctggctccagacccacactcttaactctcatttgaaaggcttacatcatctcaacgtacccttcagaagatgatcttttttatttggtatttgaagccacacagaacaataaccaattcgattaaaaaattaaatattggagttttgagaggtttttaaaatgcctatttatgggttgaaagggatagggtgcagtcttatcactgaatgtggtttcaggttttacggtgaaagatgcttcttactcctattccaccaggaatattgtctgaatatcgaattacctaattaagtgactgttggatgacaaagtgttaactgacagcccaagtaaaatcaaggttgtctttaccaagaatttaatctgaaggaggagagaaggaaagctctcccatgggatgacagtgttctgggagacaggctggatgggtggagagtccttcttaaatgagaagattctggattccttagcaacaggatggactggagagaccactgattcatttaaacacaggagtcgtaatgaaaactctgccaacatcatgccatacaagtctaatcaatttaatgattcttcagtgtgtctgtgccagtgcctccttccaaggctttgggcagtggggccagggagggaatggtaggctgggaggagaaattgaggaaacctgacttggtgaagcattgaatgcccctgacggtttgcctggttcatgtacttcgtatgtgagacttcttgggttcattcttatggtaagtgccccttaaaatttattcattttaactttttgtagaaaaatgcaccataattttgaccaccttaaacatgtttcactcacaaatgaatttcagaaaaggctagcacatgtaattgaagttatataggcatttgcagacttgactacctgaggtgtatggtgttcagacaagtttccagaagccaaagaatcaaaacaataatgaccttttttaatgctatgaaaatatcccaaatgtacgtaaagcagatttttttcagagattaaattatagagaagaaaagataagcaaatttccctgtagtattccggctttcctttggacaactgaatgctaacaatttatttgggaattgtatttttaaaaaatagagcaccagattgctattgaggtcttggatctttgccagaaagtctcaattccaatcgctgtggaaaacaattccctcaggcagtggtgacgtgtgagactaaatgtgttgcagttagcgccaacttgaaaaacatacaactgccctaatgttcaaggcatagtgcctttgtgttcaataatccttaagaatggattaaatcaatactttctatagacatagttttctgtcaccttgtgcctgaaggtgattgcaaatgcctgaatcctggctgcttttcagtacctctcatacttcatagtatgagattgtaattttgactttagaaaaatctgtcaggtaacattaatgacctcccgaatgctctgccttacacacatggataatagaactaggatacaaatctactttctatagtcatgtcacagtgcagtcttacccctccaacggattaaagtatgattctttagggcagtagtttgtaaaaagagattgacttcttttttctggatctaatgaaaaactccatggaaagaaattagaattatttattctggtaaagcaggtatttagtgaagtaaccaaaggcataatatagatgatgaggtgactctaaaagttctttatttttatagcacaaagatggccacaaggtcatttgtgaaaatgcagcagtgtaaaccggttaaaggccacccaactttttgtcggagtgtgcatggcacattaagaataatgaacctgttttccctggcaaatctttaaatagcagatacccctagaacttatgcttcttgagagactcaagaattttccttccagttagtaactgaacaccatttcaaggaagagaagcaccacttggctatataatccataaatgcatttatttgttttattatattttgaactgccatctacatcccctagcacacagcctaaaaagaaagacactttgtgattatcgataagctgacaggaaaaaaaatgagttttctccccttttcgttgatgttttgtaatatgttttctagctactaggtggactacatactatagtcacatgtgggccatgagaaatacttcgaattacattcaggcaccatgttgtaaaggtcctggactttgtttttactgattttgttaaccgtaaagatcgctagtaattaaaaattggcagttagtccatctatcttcaatttatgcatgaataattatgcagatttcccagggttgctggacagccaaaaatagatacaggggaagccctccaacttgatagcagcagttatatatttgtactctgagctctaaggagcagcaaaggccccactgtgtcgtcttcctgtggtttttatggcacagaaagccaaaaatgatttcagttcttcactgagggctgccaaactattggcccactttatgaatagttgcatatgctttgttaaaaaatttttatacttgcagtctcagccaaaatccaaagtgattttctaaaatataattaatactccatgaaattctttgcactaataaagcacaaaaagatagatatacaaacttggtcaccttaatagaaatgcctgaatgacattaaacttttaataagtaagtcttcagttgatctggtgccatcactgtttaagtgcctgcccgtgaatccgcttcattttgtagagaagctatatctcttgaaataaatattaaaacaaaatactctccctagtctatagctttaatttttattgggatatctttaatttttattggtatttttaacaattattatgggaatctgtaaagttgatacatggcaaggtagtaatagcctagtaaagcatttcagttccaaagacaatacttgaatagtggaaggatttaccaatgtgcaataattaaaattagccatgtaaaactatgggacatagacgaaaaggcaagccataaagtaagtctcagattatcttactctaaatctgaattttgctacgaagtacccagggacattgtgctgttctttttctccgtgctgggagattcgtgctaggtcgtgctgcattattagtaaaaggctattgtgatagttaaccctcatttaggaggagctctaagatggattcacaaaatacccaaatgcatacaatacatgtgggtcaccttataattagggtctagagtaatttggaatgtaaagcaatttttattctgaggtttcctaattcaaatgttaatagtgcaccaaaaggtcaattcaagagtttattattattatttttcaacccaagtaaaagcagagagaaaatagccacctccaccatagcctcagaagcaagccaacagcctgaaacagctttgaaatgaaaagttggtgtggcggtgatggtggcagtgataatggtgacgatggttgggtgctggtgatggtagtggtagttgtgaaggtggtgatggtggtttgattgatagtaaaaaaaatgttcgttaatacaagtagagagtaagtaatcaatcaatcactcatagccaaggtggaaaagatgtatcccatcatggaatattcctgttctgatagaaatcttgtgcttatctatggaattcttttgatatatatttacattgggaacctgaatgtagcttgacatttttccatgtaaacaccagtagcctgatccaacattaagctgatactaacaaacaacgtgtaatggcttcattaataaggctttgcttcttcctggaaactggtgaaaaatcaaaccttgttgtgtacaccctcgatgcagcttctgtgttgtcttcacccagaaatggggaatgatttcccaaatggcaaagaaacagagtgatgctatctatctgcaccttttgtaaagtctgtctttctttctctttgttttccaggacacaatgtaggaagtcttttccacatggcagatgatttgggcagagcgatggagtccttagtatcagtcatgacagatgaagaaggagcagaataaatgttttacaactcctgattcccgcatggtttttataatattcatacaacaaagaggattagacagtaagagtttacaagaaataaatctatatttttgtgaagggtagtggtattatactgtagatttcagtagtttctaagtctgttattgttttgttaacaatggcaggttttacacgtctatgcaattgtacaaaaaagttataagaaaactacatgtaaaatcttgatagctaaataacttgccatttctttatatggaacgcattttgggttgtttaaaaatttataacagttataaagaaagattgtaaactaaagtgtgctttataaaaaaaagttgtttataaaaacccctaaaaacaaaacaaacacacacacacacacatacacacacacacacaaaactttgaggcagcgcattgttttgcatccttttggcgtgatatccatatgaaattcatggctttttctttttttgcatattaaagataagacttcctctaccaccacaccaaatgactactacacactgctcatttgagaactgtcagctgagtggggcaggcttgagttttcatttcatatatctatatgtctataagtatataaatactatagttatatagataaagagatacgaatttctatagactgactttttccattttttaaatgttcatgtcacatcctaatagaaagaaattacttctagtcagtcatccaggcttacctgcttggtctagaatggatttttcccggagccggaagccaggaggaaactacaccacactaaaacattgtctacagctccagatgtttctcattttaaacaactttccactgacaacgaaagtaaagtaaagtattggatttttttaaagggaacatgtgaatgaatacacaggacttattatatcagagtgagtaatcggttggttggttgattgattgattgattgatacattcagcttcctgctgctagcaatgccacgatttagatttaatgatgcttcagtggaaatcaatcagaaggtattctgaccttgtgaacatcagaaggtattttttaactcccaagcagtagcaggacgatgatagggctggagggctatggattcccagcccatccctgtgaaggagtaggccactctttaagtgaaggattggatgattgttcataatacataaagttctctgtaattacaactaaattattatgccctcttctcacagtcaaaaggaactgggtggtttggtttttgttgcttttttagatttattgtcccatgtgggatgagtttttaaatgccacaagacataatttaaaataaataaactttgggaaaaggtgtaaaacagtagccccatcacatttgtgatactgacaggtatcaacccagaagcccatgaactgtgtttccatcctttgcatttctctgcgagtagttccacacaggtttgtaagtaagtaagaaagaaggcaaattgattcaaatgttacaaaaaaacccttcttggtggattagacaggttaaatatataaacaaacaaacaaaaattgctcaaaaaagaggagaaaagctcaagaggaaaagctaaggactggtaggaaaaagctttactctttcatgccattttatttctttttgatttttaaatcattcattcaatagataccaccgtgtgacctataattttgcaaatctgttacctctgacatcaagtgtaattagcttttggagagtgggctgacatcaagtgtaattagcttttggagagtgggttttgtccattattaataattaattaattaacatcaaacacggcttctcatgctatttctacctcactttggttttggggtgttcctgataattgtgcacacctgagttcacagcttcaccacttgtccattgcgttattttctttttcctttataattctttctttttccttcataattttcaaaagaaaacccaaagctctaaggtaacaaattaccaaattacatgaagatttggtttttgtcttgcatttttttcctttatgtgacgctggaccttttctttacccaaggatttttaaaactcagatttaaaacaaggggttactttacatcctactaagaagtttaagtaagtaagtttcattctaaaatcagaggtaaatagagtgcataaataattttgttttaatctttttgtttttcttttagacacattagctctggagtgagtctgtcataatatttgaacaaaaattgagagctttattgctgcattttaagcataattaatttggacattatttcgtgttgtgttctttataaccaccaagtattaaactgtaaatcataatgtaactgaagcataaacatcacatggcatgttttgtcattgttttcaggtactgagttcttacttgagtatcataatatattgtgttttaacaccaacactgtaacatttacgaattatttttttaaacttcagttttactgcattttcacaacatatcagacttcaccaaatatatgccttactattgtattatagtactgctttactgtgtatctcaataaagcacgcagttatgtta

SEQ ID NO: 4459 - DNA, 1036241 bp, human; identical to SEQ ID NO: 4458

SEQ ID NO: 4460 - DNA, 1297518 bp, human
atgactgagatgattttgctaattttttttccagcctatttccttaatgtacgtgatattgtgattgattttcatgcagagatccctgatcctatagttttgtttgctatttatttttctccttcacattttttttctatcaacagagctgaatgagtgccaggaagctgcgaaatctgtcttacaaaaaggtgattgtggaagagtctagaatcttcatttattgttcagcaggattacagaaaagctatcaagagtaaacatttaactgatacactcttattccttctttttaggctgtaaggaggcaaaagttgcttgaacagagcatccagtctgcccaggagactgaaaaatccttacacttaatccaggagtccctcacattcattgacaagcagttggcagcttatattgcagacaaggtggacgcagctcaaatgcctcaggaagcccaggcaagtacatctgggaatcagcttccattcttttgtttttattacttcaacaaaatgttgcagtgtttctaactttaaatttattcaactagttttccatggggttgttttgattcactgatttgactatttggaggtaggtaggaagaaaagggggtctagatcattagtctaagatttatttttttaaggatgtaatggaggaatttgaaataaagacatttcaaagacaggagcaatacgttctggtgtttctgacttcaaactatactaaaagctagagtaaaaccataggatagtaaatggtaaagaaaatgttttttggccgggtgtggtggctcacacctgtaatcccagccctttgggatgctgaggcccacgaatcacaatgtcaggagttcaagaccagcctggccaacatggtgaaaccctgtctctactaaaaatacaaaaattagccaggtttgttggcacgcgcctgtaatcccagctactcgggaggctgaggcaggagaatcacttgaacacgggaggcggaggttgcagtgagccgagattgcaccactgtactccagcctggaacagagcgagactctatcttataaaaagaaaaaaagaaaatattttctatggcattgttggaaagcagtctcaaacattttattataaactcctcgtttagtcacatggtctatattgttttataaaaatgtgttagttacaagcagtgagtaacacaaaattatcgatataaatttacacctcaattattaatgatcatgctcaatatagctacatgcactcactcccatgcttcattcaaacgaaaatataaaacgtgtttacctgtttttctagaatgagaattaaaatagtgttgaaaataaatctgagttgacttttaaatgagtaaattttaggccataactaaatttacattcactgtaagaagtatttttaaaatgctgttctcattttttaattaacatttaaacatatgtgaagttatcataggtattatttattcaaaagtctttagggttgtgtgatcgcaattactagatctgcttttcaaatcttatatacatgttgtgaacccaatcaccaagtccatgctatgatgagaggagcactagaaggttagctgcaaatctcaaagccttctccctgccagttggtgaagatgtctgaagtttttcactttaaaatgaatttgggggtgatatattagatttgtagatcatggttacaatgcaattacagttaatgaatcaccgttaataggtgttctgggcaacagtatacacaatagcatgagttaatttaccatattgtctaactttgaccaagaatgtccctgataatatgtggcagagtataggtagttttgataggcttaaaaagtccagggaatattatttccttatggagtgcatacaattgcaatagtggatgaagaaagagaattttggggagaatcctgatgataaaatcctcatcatagttttccactgggcaacaagagtaaatattgtagtagaagtgagggataatagtaaacatacttgaggattcaatttttaatttgtcttgatatataatgattgtacatattttagagggtaagtgtgataggtttatacaaacctactccagtatatatatttttcaaacttacacaagccaggttctctagaattaactattcctaagtccgtcccagtttgagtcataatgaaaaaggttttttgatataaaatatttatacatatttatggatacaacatttatgtaatattttcttacatgtatagaaagtgtaatgatcaagtcagggtatttagtgtgtctaccacggcagggtttagtaaaatgcatgataggaatgagtaattgtttctgaattgagaagaactacatgactataaatgaaatacagagtagaactgctttcatttaaactaatgacatgagttttgaaggaatgtttgattaaaaatgcttgtgacgttctgaatggaattaaggaaaaatttgagcagtatgaatactagacattaatattgcaagtttgtacttcaaaatgcataaagaattactttgtgacagacttgcggaatgaaattatgagtagcaaatttgataggcaaagctattatactattgtctttcaaggaaaattggagcttttagggcgaagcatctttagttgaacaggttgtgataaggggcactgtgtgttttttcttatttagaaatggattcaggattttataaacattacttgtttttaatagcaaaatattttgcttggtttttctaaaaaaatactacaataaaaatgttattaactacatcagtagaaaagtactagtaaacagcagaacacagataaattatgaaatttcagatctacttcaagaaagagattttgggcattcagatcaaatctattttccatgcatttcaggtcacacctgcattatcaacatagttcttgacattgagtctccccaatggtaatacataatattggagaatacaagccatctgaaagctcttaaaacattcttctgctccagggttttattttaatatggcagtaagtgaattgttttctagaacagagttctcaggtactcagatttgcttcaaggattatatttcctgaaaagcagctcgaaattcccatgaaataaaatagagagtcaaaagttagatagtgaaataacataagcacagtgtgtaagatgaaggatccactaagaatgccaccaaaatgacattttaaatatagagatggggtggatagatggatggatgtatggattgatggatggatagatagatagatagatagatagatagatagatagatagatagatgaaagaaagaaaagaaaggaatagaatagggactaacttcaatgcattgtattaacaaaaatgtgtttctataaatttgcacttaaagataaaaaggttattgctaattaaaatattagtgcactataatttcttttctcataaatggtatatttagcttaattcatcacggagaagcaggaaaaaatgtatgaagttaccatattaagtcctctttgaaatacctgctcagattttctgtcatatactggtcacgcagatttgtgggtgtctgactccaccgtgtggtgcactgagagttttgctagttaatttgaatcttttagagcattattttttctgcattttaagatcgtttgagatcctcagatataaaagctatggcactaaggaaatgcatactgtatgtacaactttctgacaaccatactcttgttatatataaaagtagatgtagatcaggatgcttctttacattcacattggcatttattactataggaaagaaaagagctgctcacttccttagtgtgttaattgatcagttatttctctgggccctcagattctgaattggatttaaaattatgttacttattttagtgacatgagcttacctacagaagcaaagcttacacttttagaaaataaagctgcatgctgccaggatgtaacagcatgtgttgacctaggagtattttatttcaaaagataacacttagccaattcacagtctttttttttaatactttaagttttagggtacatgtgcacaacgtgcaggttagttgcatatgtatacatgtgccatgttggtgtgctacacccattaactcgtcatttaacattaggtatatctcctaatgctatccctcccccctccccccaccccacaacattccctggtgtgtgatgttccccttcctgtgtccatgtgttctcattgttcaattcccacctatgagtgagaacatgcggtgtttggttttttgtccttgcgatagtttgctgagaatgatggtttccagcttcatccatgtccctacaaaggacatgaactcatccttttttatggctgcatagtattccaaggtgtatatgtgccacattttctaaatccattgtatcattgtgagacatttgggttggttccaagtctttgctattgagaatagtgccgcaataaacatacgtgtgcatgtgtctttatagcagcatgatttataatcctttgggtatatacccagtaacgggatggctgggtcaaatggtatttctagttctagatccctgaggaatcgccacagtgacttccacaatggttgaactagtttacagtcccaccaacagtgtaaaagtgttcctatttctccacatcctctccagcacctgttgtttcctgactttttaatgatcgccattctaactggtgtgagatggtatctcgttgttttgatttgcatttctctgatggccagtgatgatgagcatttttttatgtgtcttttggctgcataaatgtcttcttttgagaagtgtctgttcatatccttcacccacttgttgatggggttgtttgcttttttcttgtacatttgtttgagttcattgtagattctggatattagccctttgtcagaggagtaggttgcgaaaatcttctcccattctgtaggttgcctgttcactctgatggtagtttcttttgctgtgcagaagctctttagtttaattagatcccatttgtcaattttggcttttgttgccattgcttttgttgttttcgtcatgaagtccttgcccgtgcctatgtcctgaatggtaatgcctaggttttcttctagggtttttatggttttaagtctaacatgtaagtctttaatccatcttgagttaatttttgtataaggtgtaaggaagggatccagtttcagctttctacatatggctagccagttttcccagcaccatttattaaatagggaatcgtttccccatttcttgtttttgtgaggtttgtcaaagatcagatagttgtagatatgtggcattatttatgagggctttgttctgttccattgatctatatctctgttttggtaccagtaccatgctgttttggttactgtagccttgtaatatacagaaaaagagaattttagaccaatatccctgatgaacatcgatgcaaaaatcctcaataaaatactggcaaaccgaatccagcagcacatcaaaaagcttatgcaccatgaccaagtgggcttcatccctgggatgcaaggctggttcaatatatgcaaatcaataaacgtaatccagcatataaacagaaccaatcacaaataccacatgattatctcaatagatccagaaaaggcctttgacaatattcaactacccctcatgctaaaaattctcaataaattaggtattgatgggacaaatctcaaaataataagagctatctatgatgaacccacagccaatatcatactgaatgggcaaaaactggaagcattccctttgaaaactggcacaagacaggggtgccctctctcactgctcctattcaacatactgttggaagttctggccagggcaattaggcaggagaaggaaataaagggtattcaatcaggaaaagaggaagtcaaattgttcctgtttgcagatgacatgattgtatatctagaaaaccccattgtctcagcccaaaatctccttaagctgataagcaacttcagcaaagtctcagcatgcaaaatcaatgtgcaaaaatcacaagcattcttatacaccaataacagacaaacagagagccaaatcatgagtgaactcccattcgcaattgcttcaaagagaataaaatacctaggaatccaacttacaagggatgtgaaggacctcttcaaggagaactacaaaccactgctcaatgaaataaaagaggatacaaacaaatggaagaacattccatgctcatgggtaggaagtgtcaatatcgtgaaaatggccatactgcccaaggtaatttatagattcaatgccatccccatcaagctaccaatgcctttcttcagagaattggaaaaaactactttaaagttcatatggaaccataaaggagcctgcatcgccaagtcaatcctaagccaaaagaataaagctggagtcatcatgctacctgacttcaaagtatactacaaggctacagtaaccaaaacagcatggtactggtaccacagtcttaaattaaattatatggccacagcatcaatctacccagtgtcagctcatttaatgagagattttattaaagtacaaaattaagaaaagatttattgaaacagaataaagcaaatggggaaaactcttctagatatggaaatatatcttagaaaacagaaactaggattatttccaaagtactatgattaaaaatgtaacaacctatgcgtgttccttggaaataaataaaaaattaaatcacgaaattgtgtgactgcaaagaaacacatggaacaaatttagtcatttactgttcaatttttcagaactatatattgaagcacagagtttagttttggcacctaaaatcctatagcaacagtctaagtaaccatgctgagccccggagcaatcaaatcaaatctttaggtggatttggtcttcagaatttttggaaacttttttattcattctaatgtgtagctaattggagaatggctttggatggttccctactagtaatgactaaattgttccagagtatttttcatacgacattttctatcactcttctataaagattctcttctatgactgtgtcaacgtttcaatgggagggagtcagagtggcaatcaaactactggtgagattctctcctattttgattttttcctctaatggaaaatgggtgatggaagaaaatatagctgagagctatcgcacaaattttaatttagacaaaaagaatgttcaatatagatgtttgaggctgaactctgcttggctttcttcaattcatttttttctaaccccatttgttaacatgtcaattaacttgcatatggctcttaatcattttaggggacagtgacaactatgtttaaatagctacttaaatgtcttgcaatttttaaaattacaaagatactttcacatacatgatttttttccttttctactaattttagttttgaatctttgatatgtaagaacaacccaacatgggcacctgttgaaagtcaccatgtccttatgtgttgatgcacattttgtaggggaaaacatggccctgttgcttaaattactgcaagcaagagcggagttgcttagcagtggctccagtagctttactgttctatttgttttttcccaaagaattctgatctcatttttttgtaacctcgtgtcccacatagtagatttatgagcaggaatagaggaaggaaacaaattaccttcaaagaagagtgcctcataattaaatattgaaaaatactgccgtggtttgctcaccaagctaggacgtcaggtgttccagagtccactacagaccagacttcctccttctctttttccctcccattaacaatgtgagtacaatttagaaaagaggggatttttaaagcaaagaaagctattaatttaaactaattacgttaaatgcactttaagaagaattcgtaattgcaatcttcccgtgtttatcaaagaagctaaatcttataactcacattaaatataatcggtcatctttaaatgttaacattccaagctatcaaaatcaatggcttaaaaataaagatataactgcagattttggtctatcagattgagcttttgatttcattaaggaataaaacagactcttatagtgtaaataggcatatttgattgccaaacgacttggaacagtgtaactttacagtctgctttattgatttatgagttagacagcagaaacctgcaaaggggaatttatgtggtaattggataatttagtcaaagaagaaaaaaatggagaactaacccagagatttgggttcaaatattaaaacctatctagccatagatgtagactttttattttctttttacacagcccagtagatggtaaacctagtgcatttaattttgaatctgttctaacattgaaaggccacccctatgtgttgctatacagaacttattactctccatttaagaataacttgttagtttcatatgtttaatagtgtgggaaacagtcataaacacaagttgtaggaaatgtaaaatactagaaacttgccacacgtcactgactgtacttggacaacctgtacattattatgtcctcactggctatatgataaagatatagatttctttcatattattttgatgtgtacattttaagactgcaattaaactatagtatgcttttgtaaaaatctatctacaaattctacatataaggatgaaattattaaaattaatggcaaaaactgcaattacttttgcaccagtctaataacttcacgctacagccacagtgaacactattgcaacactctgaatattttgaagtgatccaaatttatcctattatttcccaattttgtcttatgcaaatgaatatttacttcaaagatagcacacagaaaatttatcgatctaaaatgcacagccagataacacttagcataacatactatgttttatttttctttcagcgtttatcgtgattgttaaatcttttatttgctttttaaaaattttccccgtctattcccattctctaaccactaaagttcagctgtaagaccgtgggccacccagcagatttctaacaaatagctggcaaatttattgaattccactgaggtttagtcactaagtatgtgtcagacaaatgtgataggcagtgtaaaatttaaaatgtgaataagcctaacgtggtccttgccatcttgccactcattagatagcaccaaagaaagataaaatttagaaattgctggccacttacgtttaccataatagtgaagaaccatttttccaatggaacttaatagtatcataaagacttcttgtcataatgccttatgattgcccaactttgaagctctgaaaacctttccaaaatactttgaatagtataaaatggaactcttcacatgaaaaggaaagactgatggaaaatatatattttagcctctttatgtattacctagtttttaaggattataccatgtgaatatctaatattttgaaagcattcacgttatttggtaattacagcagcctaatgaagtataaaagttgtgtttaaaagggaatatttgaaaacactagatgaatggttgaggcatgggttgagaacaggatgtgaatgaaaatggacacacaggtttaggggttaataaaaaatgtcctaaagttggattgtggtgatatatacatgactctataaatttcctattgttcattgactatatgtttaaaatgaaaattttatggtatgtaaattgtacctcaaagttgtttttaaaaccctattgaatagagaatatatcaattactattatatatttaaaaagataatttaaggttaccatcaactttttcactccattattttgatgcatagcaaagggtgaaatgtgatgaatgttgttaaataacctggaattaacttaaatggtagatatttattgatggcctactgatgtccgcaagatcttacatagtaatatcataatgttcccattgtttacattctattccatttaatgaattttaatgctaaagcatttttactgaagctgatattttaactcagatctgctttctccactttaataattagccctttattaagtgaaaattaacctagaagtacaatctcccaattatttctaggcagcattccaaaatgttccctagagtttgatttactcatttatctattttgaaaagtaaccataattacttgaaaatacgttatttctattttcaatgtttgtaggcacgtagtagatgtataaacgttacatgagatattttgatacaggcatgcaatgcgtagcaatcaaatcagggtaaatggggtgtctatcaccttaagcatctatcctttgtgatataaaaaattcagttgtactcttttagtttattttaaaatgtagactcaaattacttttttattatggtcatcctgttctagcaaatactaggtcttgctcattatttctaatttttgtacccattaaccatccccacttcctccccaacccctgactacccttcccagcctctagtaaggatccttctactctctatctccatagttcaattatcttaatttttagctcccacaaataactgagaacatgggatgtttgtctttctgtgactggcttatttcacttaacgtaataacgtacaattccatccatgttattgcaaatgacaggacgtcattctttttatggctgaatagtactgtattgtgtataggtaccatattttcttttttttattattatactttaagttttagggtacatgtgcacattgtgcaggttagtcacatatgtatacatgtgccatgctggtgcgctgcacccactaactcgtcatctagcattaggtatatctcccaatgctatccctcccccctccccccaccccacaacagtccccggtgtgtgatgttccccttcctgtgtccatgtgctctcattgttcaattcccacctatgagtgagaacatgcagtgtttggttttttgtccttgagatagtttgctgagaatggtggtttccagcttcatccatgtccctacaaaggacatgaactcatccttttttatggctgcatagtattccaaggtgtatatgtgccacattttctaaatccattgtatcattgtgagacatttgggttggttccaagtctttgctattgtgaatagtgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaaccagtttacagtcccaccaacagtgtaaaagtgttcctatttctccacatcctctccagcacctgttgtttcctgacttttgaatgattgccattctaactggtgtgagatggtatctcattgtggttttgatttgcatttctctgatggccagtgatgatgagcattttttcatgtgttttttggctgcagaggtacaaggaggaactgataccattccttctgaaactattccaatccatagaaaaagagggaatcctccctaactcattttatgaggccagcatcattctgataccaaagccgggcagagacacaaccaaaaaagagaattttagaccattatccttgatgaacattgatgaaaaaatcctcaataaaatacttgcaaaacgaatccagcagcacatcaaaaagcttatccaccatgatcaagtgggcttcatccttgggatgcaaggctggttcaatatatgcaaatcaataaatgtaatccagcatctaaacagagccaaagacaaaaaccacatgattatctcaatagatgcagaaaaagcctttgacaaaattcaacaacgcttcatgctaaaaattctcaataaattaggtattgatgggacgtatttcaaaataataagagctatctatgacaaacccacagccaatatcatactgaatgggcaaaaaccggaagcattccctttgaaaactggcacaagacagggatgccctctctcaccactcctattcaacatagtgttggaagttctggccagggcaattaggcaggagaaggaaataaagggtgttcaatcaggaaaagaggaagtcaaattgtccctgtttgcagatgacatgattgtatatctagaaaaccatattttctttatccattcgttttttaatggacatttaggttgcttccaaatcttgacttttgtgaacagtgccgcaataaaacacgggagtacagatatttcttcagtgtactgattttctttcttttgggtatatacacagcagtgggattgctggattgtatggtagctctgtttacagttttttgaggaatctcaaaacttgttttccatagtggttgtactagtttacattcctaccagcagtgtatgagggttcccttttctccatatcctcgccaacatttgttattgcttgttttataaataaaaccatttgagttgaagtgagattatatctcactgtggttttgatttactattctgttatgatcagtgatattgagacccttttcatatacccgtttgtcatttatcttctttcaaaaaaaagtctattcagatattttgcccatttttaatcagattattagttttttcctatagagttgtttgagctctttatatattctagttattgatcccttgtcagatgggtagtttggaaatattttctcccattccatgggttgtctcttcactttgtgggttgtatgctttgttgtgaagaagatttttaacttggtgtgttaccatttgtccatttttgctttggttgcctgtgcttgtgtggtatggttcaagaatttcttgcctagaccaatgttctggaggtttctcccaaagttttcttgtggtagtttcataatttgaggtcttagatttaagtatttaatccattttgatttgatttctgtatacggttcaagatagaggtctggttttattctgcatttggatatccaattttcccagcaccatttattgaaggactcctttccccaaagtgtgttcttggcactttgtcaaaaattaggtccctgtagatgtatggatttatctctgtgttctctattctgttctattgggctgtgtgtttgcgcttaagccagtaccatgctgtttcggttactatagctgtgtagtataatttaaagttaggtaaagtgattcctccagtttcattcttttttgcttaggatatatttggctattctgggtctgctgcagttccatataaattttaagattgttttttctatttctgtgaagaatgtctttgttagaaaatacattattataatgaactcttctattatcgttgtcgttattatgactaagcgtaacatcgtttctcaggtatattacaagtaataattatacacaatgtccaattttttatttttaaacggttctgtggtcaagattacgcagaaaaatttatatgctttacttctctgctggagatttttgacccacttttttgtattttcaaaaataaaagtttaacctaaatttgataagaagccacagacactttttcctccagaaatatgttgatataccacaaaactcatatgtcaaggaacaatgtaggggagacactgaaatagactgtttcctttggcctattgcatatttctgataaaagtcaaaacttctttagctgacaaaatttaatttaaaggtaatatttttctaagtaactctacttgggggggggggtttaaaaaaagagtagtacaaagctgtgtgaatttcttctttttttacttgttgaattattataaagtataacctgaaacttttcaacattttttttctatgaaaataattatatttcttgcattttcctatctttggaaagtacatatcatcccaaatcttttgatatattttgtttctttcgttttctaagtacgtgtgatatgtggccatttccctttcttgaaaatagcaatttcaaaattactggctctttcaaaattactaatctaacagtggtacgttcctccatcaatcagtagtctcaacatgaagtattttaatatcttttactaaaatattttcttattttctctaaatttttcctttctttgacaccacagaaactccaataattatttgatatcattttcttcattctgttaagtactttagcctgctgcagtataattttgctggccattttctgttactatatatatgagaatggtttgatgaggtaaagcaagattttaaaaacagccctgctctctgctcagttaactgtaaagtcctatatttaaaatgtgattaatgtttgaatgattttttggttctataattttgccctttaccatattcaatggaaaaatggttaattcgatttcacttgttttattttcctactttgaatatatagtgctgtgaacatagttactgcatgctcaaatgccttttttataatggaatgttgagataagctcaaatgtcttttttaatataatggaaagatgatataatttgctttatattacttgactttgatgaagaaaatctagtgattctgaaaggtactggattgagaacacctcatagagcatatgtgagtgttcacatcagtatccgtgatttgctatgtcctctcactttgtttccattagagtttactgattttatacgaagccaggctgataatttcacaagaatagttgtatgtggttggcttatttgttttcttcaaatgcttactatccatatccccctagatgtatatattaggtgaaaatataactcaaattatacatccctcacatctttaggacaacttagaaatctagtagacaagtagagagatcattttccttcagattgaatcttctatccccaatgttttcttccacaattttattttctttcatcatattctcataatgtcaaaaaagaaaatgattacattgtctttttttatgagtgatttttacataggagattgttcttcccagaagtttcaataatattctgttatttgtacaagttacttttctatttcacaataagcctgcgctaaagtgctaagcattttttacttatgtggttccagaatacagttctgacgaggttaggtaaagtagctggtaaaagatatcctaagtacaagctaaaagttaattacaatttaaatgtaaattttgtggaattaatgtgtaaagatgctggcaaatatgtgtcatgcatgttttacagcttacccatagtagaatcaattggaaatataaagacattttattttataattttagtaatgaattgaattattattaatgaatatgttaagtatatttgatagcctttttccaaatctacttgtatgatgcactctggcaaaaaaaagcaaaaggataacatctacaaagtgttgtatgattcttggatatacacaatatatattaataaatattctgagaagttctgtggtatagacacatgttcatcttcaatttccaaaatatgtttaaccactgagttctttttaatgcataatctactcaatgcataaagaaaattttatctctaatcatattggaacagtactacaaatatgcgaatttcactagaaatgcctatacattatgataaaagtctcacttttatatgatgttcaatgatgatttttttcaatgttaataattttagtggtggcgacctttctaaaaacacagaagctcatcctcaacagtttttctaactatttaatggaaatatgtatatttcaaattccatggaatgctttgccttgagctccaaattgcccaacattcctctcacaggttacttggtccttcatgtcccctgccaacagataaaagtcgagtgtttggttatatgtaagctgttgttgttcctattatttatgacttatgacaacaatatgactcatttgggaaaatgtggaacttatcaggaaggcctgtgttgcagtgatcacttacgctatctttgctttgctttgtaatgctgagcttctagaatttccaggggcagtctttgaaaaaaaaaattataaatagaaaattaaatgctggtttatagaagggtctcttgcaagtgagaggcactgaaacttaaggttctgtagcttcatactaattcctcatctagatagtaattcttactaactcacattcagtctttcctcccattaaattaagcacacacactctgcatgccccaagcctaatctttgctagcttgtttcctacagcctaaaataagatcctatattcttattctctgaccctccaaaaccctttctcagccatatgctagttaaatcatgtaaatttcctaaaaatcaccagattatacagcagatattaatatttatctttctgatcacagagcatgggtttttctgtttttaaaatttttttaaattatactttaagttctagggtacgtgtgcacaacatgcaggtttgttacgtatgtatccatgtgacatgttggtgtgctgcacccattaacttgtcagttacattaggtatatctcctaatgctatccctcccccctccccccaccccacgacaggccctggtgtgtgatgttagtttttctattacattgcatatatttctgctttgtaatttacttatatatctacagtctgcctcttaaaataaggcttctgtaagtataggggcaacaattttgttctcactgtgtggaattgagtagtagaagctgaacgatttgttgaattaaattgactaaatgctatcaacatacgaataagattaaatttctttttttctcacaaatgtccatttggaggatacttttattttaaaatcataattaaagaggcagtataattgttagagggcagcaagtttgttacttcctagttatgttaccttgggcatgttgatgtttctaccttcatttgtacatgaagatgataaatacttatgttaatatgattaggagatggaattaattatataaagtgttagcacataagttcccacaaatatctgtggtggtgaggatactgatgatgatttcttttctttttttttttttttttgtttttttgttttttgctcttctttgaccactctggtataaaaggttaaaggactatgtgtatacttcattttttcctctactaaccttggaggctaaggggatggaaaaacttttaaatacatgtacacagatatgattacagatgtataatttgggccctctaccctctctgagtgtattcttatttttttaaatcagtttcctttcacagtctccacaattgctattgaacttttatcactttgatttaaattccaccttgattctctcctctcatcctcagcagatacctagggttttgtgcttacgaggaaatgacatgttatatcgctgataacttataactaaatatttgtgcaaataacatggacaggtatttttacatatactgtcacatctgatctttttgaccaaaaccaatgtagttgactactgaagaaatgagaatttctcagataagaaaacttcattgctggcttgctattatcattcttgggctagacatgagaaaatcaaggttcagaacatgttgatgctttgcccaaggtggcaagagagagccctgaaatttaaatcctggttactgttaacatgatttcaccctgatactctgagagcaccatgtaggaagcattcaacttcttgcgtcttcacatcttacttttgttttctgaaaaagagccacctctcctcctgttgatattttccgttggccctgagctttgtgcttcactctggttttcttgctttaaacaggtttttttaaaatcaagtttatcttcttacatttaaaaaaaatcactttatgtgttggcttctttcatgtagccttaaagtatgttcaagtctgattgacctgaattttattatgtgtggagacaaaagtctgcaaaagtaatttaaactatttttattagagtgctccttgatccttaatcaggccagcccttgaaaatacgatttctgctctcgtcatccacttctctcttctagctgcaatggtcattgacgagctcatgtaccctgattactattgatcccattgaacctatctcaaactgtcactgttgacctctctctctcattcttaaaattctcacatcaattgatgtgagattttctctcttttctagttcttcttttctttctctttgactgttctttctctttatttggtgcttttctttccatgtcagttaaatttgtgttctccatggttctctctttgttctctctttctgctttcctctaacgcttgaaaacactgaaaaaatacatattatacaaatgtaccctgtttccctctttctctctgtacagacacacatagtgattattaaaatgcaaactcacttcaacatactgctgatttacagtcgcatttcctccctatgaatttccttagttatcggatcaaatattagcaataaaactactgttatctgtgattatgatcaatttcaaattttgaaatttatcttcgtgatcaaaatagtggtaaccattcatttgggacataaagttatttaatacctgatttctacctacatttcttgttaaattttgccaaactccttatgctcttcagtgccctgtctccacaccttgtctctcttcaaccagaaatgcttttgtttttacaactcctatatccttgcgtatccagtatgcatatacagtatttaggactctcatttagaagtaacaaaattgaagtaactaaagcaaaacaaatgagagagaaaggtttttcatatggaaacaggaatgtgtcatagaatccaagggcagtaataaagttttgactcaagaagggactaatgcctgtgttttggttatttatgatagccatttattattcccactaatggttttgcgtgttgagaaagctcacctggatggttctcttttgtggtttcttatgtgattttagtccattgttgtctgatactatagtaacctgaatgctcaactgggctgaacgtccaagatcactcattcacatgcctagcagttgttggctgaaagccttgttgtgattgttgctgaagcacttatccatggcctttcgatgttacttagctttctcagagcataatatgttggatggattctaaaagggagcaccctaagaatgactgttctaaaaagatagacgtggaagctgccaggccacttaaggacttttgccataactggcacttggactatattctattggtcaaagcagtcaaagagtcaacccagatttaaagagctgaagaaataaacttcacctcttgttgagggagtggtaagaggagcatgtgctgtgggagctattattgcagccctctttcgaaaatgctatctacgggctgggcacggtggctcacacctgtaatcccagcactttgggaagccgaggcaggtggatcacctgaggtcaggcattcgagaccatcctgaccaacatggtaaaaccctgtcgctactaaaaaatataaaaattagctgagcatggtggtgggcacctgtaatcgcagctacttggttggctgaggcaggagaatcgcttgaacctgggaggcggaggttgcagtgagccaagatcgtgctattgcgttccagcctgggtgacagagcgagattccatctcaaaacataaataactaactaaataaataaataaagccataccgcattggaagccatcagtgtttttgttaccacctcactccctatgcatctacttctttcttctctctctgttcatggacctttgctcttcctcaatccactctgcaaactagggacttcgtaagcacaatttgctagtatatgtgacacaattcgaagcactcacagtttgaccagactcttctgtcaattctaattttctgagagagattctgatgattctctcttaacacaagcattgtgtgtattctgatcacccataacatggagttggccagaattacgtggcacagacatggttgttactggcccacctttttgaggaggattaacatttccaagatgaaaggccctagccataacccctctaaagcatctgttactcccagcaatgcttactaattattgaaagttctactttaacatcaactcccttatgacatcctccgtacaagcatcactccaccctgcatacttccatccaattttatagattctgtgatgtttcttgctctataaataacgtcatgcacctagatggatccctactcccagattctaggttcacgaaacatatcaatatttctcacacaaggtagttattcaaccaatgaagatcatcgatatggtaataaaataagatacatttatatgcgtatttgctctcatttgttttaaggcagaattctaactatttaggtaattcataattgatttgcctctataattgttaggattaatattctaaggaataatattgaggtacatctgtgaatttataaccttgcataaggagctccttaaccacttagtccatgttcttggtataattctcattactcagttcagggctatagttcgctctggaaactgctaagcaaaactgatgttatcttctaatgatatgtatcagaatttactccaattggtgtaaattcacttacactaatatacgttatgcaaaatgatctgcatgataatgttatgggcactctggtataatttagtttctgctctaaattataataatctaataatgactgaattttaaattagaatgatttgaccgctagctgattttgtatggatttgacagaaataaataaataaatgtattgtgttcgtgtccacatgctgcagagatccctgcctataactggctcagaaattcatatgttaaatgcagaatatactttactatagaacttgatcgaaaatgtctttattgaatatataaatattgaaatgttttatagttatctaaaattcacaatcagtatctgccggaagccatcaaatatctatcagacaaatagcaatacctgtttggggcatttgacttccatttcttagattcatagcttccctgaaatttaactgaaatatggcacataatgactgagtagactacactaaggccaggcacagtggctcacgcctataatcacagctctgtgggaggctgagacaggagaattgcttaagaccaggagtttgggaccaggctgggtcacatagcaagactctgcctctacaaaataaaataaaataaaataaaaagaaggtaattaaggagtattttccacatgcaattttctcattatatctcatccctgtcacagttggctgaatcttacagattaacatcatgtctttggtccgatttgagtgtgacttcaaagataaaacatatcaattctacatataatatataaattacctattgaaaatgatatctgaaatagttgatattgactcaaaatgattattgcttttttcataataatcccatagggaagaaataaatcgtttcacttggataatttatgaaagtaaaaaatatttatgataattctatttaggtgatccacctgcctcgacctcccaaagtgctaggattacaggtgtgaaccaccactcttggccaatttacggtcattttaaaggaagctacatggtagaggtggttgaggagagtttctgaatttcgtcttcttggaaagttagttgttctttgtagagcatgctgactaataatgctatcctcccaacagaaaatccaatctgatttgacaagtcatgagatcagtttagaagaaatgaagaaacataatcaggggaaggaggctgcccaaagagtcctgtctcagattgatgttgcacaggtatatgttatttcagaaactaaggaacgtgttttcgttgggcattatactccagtctatattggacaacttgattattggcaagattggatttgaggacattatttgaaaactataatttgatgtctaaacaatgagtgttttgctctctacattttaaagataaaataggttaataaattaccttttatttagtataacattaagaaaaaactactgaatcattctcccaaatgtatgttttcctgtgttggatgaatggaaaaatactgctttattttgtttttatttttctgtatatcttcagaaataaaggcagatctatcaataaaaataggaccagttattgtttgaaaggcaaaattaaatcagtgcctttttacactgtccttacagaaaaaattacaagatgtctccatgaagtttcgattattccagaaaccagccaattttgagcagcgtctacaagaaagtaagatgattttagatgaagtgaagatgcacttgcctgcattggaaacaaagagtgtggaacaggaagtagtacagtcacagctaaatcattgtgtggtatgtatttctggtggcaaatacgcaggtaccccttgactttcctcattaagaagtaactgctcttttataagagagaattgttttcagataaccataataattatactatgtaattttaagattgagaacaaaaattggcacatgtattgtggcctattctgtgtgtcttttttgagtctataattctgctaagaactgtgcagaatataaaaggatgttgcttgtgtttaatttttatgattctttaaatatattttaaatggaaatctagaaaggaaatatattaatctaaaaatagtaacaacaacagtagttgcaataatcctaacaacttcagaaataatggatgccaggtaaactacgtgacatacagaagtcacctttaattcttaaggctacagattacctgagagaatttaaggacaaacagctggtgaatggcaaagcaagattccaattcaggtactcttattccaaactttaataactttcctttaaacaccagtactggatatacagtgaaatgcctcaagacaacaccgaattaaaaggcatggaaaggtacaaatagcctaaagtataaatctgatttaaactttataatattgaacggtgtcctatgttgctgttattggaaactcaccaactgagatgattcctctgaaaacaaagctgaggtatgattgcatctactcgagtaacataagtattattataactctacatgtactatcggccattagagtgggaagtcacataaaatgaaaacacagaatgttattaaagggaaaacaagtctatttagtacttgatattttaagtattgtttctacatctactccataatatcaatgaaaaacagagtccttcagatacatcgtagtcatatcatgaatggggaaatatttttctttttaacaaatatcttaaaataaatacatatatttatgtgtgaaaaatatgaggtattcttattcgataatatattttcataattcaagctgcattttagtggtataattactttaattattctcacccccaaaaagaaacttggaatagaaatgatagaaagtagttagttgatattagatgagtaaggataggaatatatgggaacatatcccatcttaaattttgccaaaaaaaaaaaaaaggaaagcataaatgacccaagtgccttattcatgactaatatttgcaaagtgagcacttttcgttcttttctagaaacaggtctctaatgttaccttataaaatgtatccaacagtaaatatgagctgaaaacaatctcacctgtgtcaagctgtgactgtgccctgcgtcagtacaaaggaaactgctcaaggcatttgctcaattggtttctggttctggtttaaatgtcaggaccaattgaagcagttctttcataagaatatccttacactgtttagttttttcattgtttacgatgctttgtggtgtataccataatcatagtcttgccttcaagacatgtttgtctatttataaaagtcttactttcatgaacacaaatataaataatatttctcccctttgtttataaatattttacttgcctattgaatgaaacaatgttaatggctaacggtaccttgagggaactttcttcatcaaaataaagcatttatattttttgaagttcagagagtaaataatttagaaaaatctctgattccaaattagcatcgttgatttccaacataataattaatttcagtgtttccagatacacagatatttttatatcttctaagaaaaaagtaaaatgaagtaaataatatcatctgggaaactcagacaaaagtcataattattagtgatgaaggaatgttaacatcatttgtcaaagaggattaatatggaaatatacatgtagcattgatcagataattgtccagcctttacaaaatgcttttttttagacattacttttaaactgaaaagagaaattaaacccaatttttgttctaattccataaaaacaattacctactgtcaggtttattttttggtaatactaaaataagtactgatagttcagatttatgactaaacaaattaaagcagagatacataatgtaaactattatatatacgtgtatacgtatatacacacacgtacatatatttgaatacatggccacatacatacaaagacatatatttctaggaaaactacaaagcaaaattaagacatcaagtggtgttggagtggtgttggtggtataattgtgaacatagctgtcttccaaagttatgacacttgtcttatgatgcttttttatagcaacctatgttttgtgaaaccgtatgtgtgtgctttatatttgtgatgtacatgtgaattgtcaataatatttttatatctggttttcatcagcacttttaagaaaataaagttgtgtaatttaattaacattgaaaaggaccttactttcttatatatgatacaatatatattgaaattatgatgtagaaatttaggtgctttaatgttactaatatgtaagtaccatgagaacaatagtgaatgtgtgtgttttggccaccactgacttcccagtgattcaaatactatctgattgatagtaaccactcaataaatacccgatgtaggagtgaattaattcatccaaatttatggctagaattatataactccaacatttaaaatagaagtcatgtaaaattcagaattgacatttatgttctttgattgaagaactaaatatatatatatcacaaaacacatatatatgattaactctctgtttaataagaatagctgcaaatgacacatatatgcatgtgtgtagacaattagaaatattaaatcaacagaaaatgcaaaagctagatattgaccaccgctgcaaaatgctactctattaaaatttcaaacatggaatagcaattaaggggatctctatttatttctgttcataatattatgaaataatttaactctactgattatcatgttttgttttatgtttaaacttagaacttgtataaaagtctgagtgaagtgaagtctgaagtggaaatggtgataaagactggacgtcagattgtacagaaaaagcagacggaaaatcccaaagaacttgatgaaagagtaacagctttgaaattgcattataatgagctgggagcaaaggtgtgtgcatgctgagaccacaaacacttctttccactttccttataaattgtaaagcaacgggcaataaattatgtatgattagagtcttagcaattctaaacacctctctctctctatgtatatgtatacgtatatatatacacacatatacgtatatatatatatgtacacatatacacaaagataaacatatacacatatttcgatgtggaattctcattaagaaacaataattaatcagtgaggctctgcttattcagattgaaaaatacgtaacgctcagggaggtttttcctggtccatcagatagctctaaaagggtttcttagttgtaagtgttccttattttcattatatatatctacttgtgatgacttgaagactggtaaatattataaactgtatctatttatatgtaggtctaatgttgttaacatattccacagagaccacattaagtttaaaaattacacagtaattatttccctatatggccaagacttgcaaaatctaccacacttggctaataagatagcatggatagccagttaagacctacgtctctgtaattatttttgtatcattgtcctgatcagagtctcatgaccagctccacttcactgctaattcaagatgcctatatctctccatctcacttcgctcaactcaaatattctgtatagattatgatagtaagtagtctcttcactctgttgattgtttgttttgctgagcagaagctttttaggttgatgcgataacagtcgtctagttttcctcttgttgcctgtgctttgggagtcagatccaaaaaaaatgtttgcccagaacaatgtcaggaagctttttcctgttttcttcaaatcattttataggttcaggttttaagtcttgagtccattttgaactggttttttatatgctgtgagataagtgtccaattgcattttcatgcatttggatatccaatttctcagaaccatttattgaagagaatgtccttttttcattgtgtattctcggccccttggttgatcagttgatcataaatatgtggatttattattgggctctctattctgttcctttggtctatatgtctgtttttatactaccatcctgctcttttaattactagagcattatagaatatttttgaatcaggtaattatgatacctccagcttcgttcttttggcttaagattgctttggctattctgggtcttttgttgttcaaaatgaaatttgggattctttcttctacatctgccaaaaatgtcactggaattttaatagggattgcattaagtctgtaaattgctttgagtggtacagacatcttaacaatattatttattccaatccatgaatatgggatatctttccataaacggatatcttagtatttccaaaaatggacttctaacattttaatttcgttctgactgaaagaactgaatttcttggaggataaaaagttatatttttacaactcaggttctcaactttagtgaatagaacaacatcactgataaaattgtcacctcatcttagacagaaatatgaatgtccatgtttgagaaatagctaaggagaggcatatttcttgcatctcagcctgaaagtagattgaaggttatatcttcaagatattagttgccaattccttaccatagaaagtaaattttataattaagttgaaatctggaagtaatcatttttcttagatagtcttgtttttatattttaaaaaccctctaattaatatttgttatgttttaaacaagtttgttgccatcctatgacaaaagattctcctactttgtttcaaaataagaaacactgatactcaattgatgggaaagcattatgataatcttgaaataaaatacatttcaactgttcatttggtctaccaaggtacctttggaatgagatacctttatatcctctagagaaatttatcattgtttaaagatcaccacagacagaaaaattgtatctgcacttgataccttattccggtgcttatcaatttttatagatgccaattatttcatatttaacatcaattacgaaggactgagtaatctctagtctcaaatgtattagagattgaataatctctaatattaatcctaatgctacagcttcagttctggagatatattgtttttgtaattataaattttaaattaataaaatgaatgtatgttatagttataaattacaaattttcagtttataatttgacctgtgtgactttatactaaaataatgtatggatgagtattttttaaattaagaaaatatatgttttggtaaaggggagtttctcagtttactttttaaaatagaggttttttgtgtgtgggctttttatttgtcataggaatttttacgaaatcattgcaagagtaaatttaacataaaataacagaataaatcaattagaatttaaagcaatgaaagtgacattagacgaataatagtgccctgagttgattattattcagaaatgaatgattctcgtaatgatgtcaaaccctatttattcctgaaaatacatatctgagagcttgtgtttattctaaccatttgccacatagtaatatccttaaagcaaaataaaagtgtatgaagaaatcatatttaactttaatagtatcacagaatacagcaaaaacataggccaaacatttatttttgaagtaaatattgatgtagaaacatttgtgactaagggatcatgtataaataccatcttataaaaatgctgtaagtcctatattctttgcctgagaataaaaatattgtctggattttgactcaaaatattttcaacagcagtagctttgtctaatgaaagcaaaggcaacaaaggaaatgttattacattattctttttatgtaagaaggaacccttctattttaaccatcttcagaatttatatggttgtgtctgccacaattgagtatgcattacctttttggagtaatcagctctggctgccataacacaataaaataaactaggtaaattgatttctgcaagtgtggagtctgggagtgcaagatcaaggtgctgatccatttcattcctgaggagagctttcttcttgtcttacctttttgctgtattcttacatggtgatgagtggggagagaaaatataattaatttattaagagatattaaagctggcaccattgatgtaataatacctataacccctttttatttctctatgctctgatttttatggaaatttacataaatagcaatactaatatcatcccttaaatacattgttaacttcgtgaaacaatgactactaaaacattttactgcaggtggcattgtgttaaacgtatccattcctcgcatacacacacaaagtataaaactcaattttccttaagatggcagtgtctcctgttttttaaaaatgtatttagctggaaataaacaaaatgaaataaataaaaatcaatactgcattagctctgggaagatagaatttctttgaaatattgaatctggaatcatttttctaccaataatgcataggaaaaatatgcatagaaacacaccataaagtatattttccctcaccccccacacacccctacaacacaaaattcttgcagtcaaaagggcagatgcttttacttaggaaaaaaaaaaatagaagggaaaatctgtttaaaaaatgaatttacagcctcagcaactaaatgttttctaaatgtacgcacacctctcctaaagaaaataaggaattttattatttggaattggaattgttatcaaggttccagaatatttatttcgattgtagcattttagatgctttatacatatttttatcttttgtgtttttcttgcttatagatagattcttattttggttgtacacacacatacacatagacacacacacacatatatatgacataaatatatgtatcagtcagtggtgcctattgggcttagggcataatgcacaaataacgcacttgtggtggtggtattgttttaaccaattccattacaattgaaattaatctggagtctacctttcagatttcttagcaacaaaagccaaatcttgtccatgttttatttacctgtaaggtagtaaaataaatgtaaataaagcttttgctctatacattcaggcacagttttttattgaaccatccctaaaggtaaataatgagaataaaggaagggattgaggtggtacaatatgtcatgctctctcaaactgttgtctgcctttaccctcgcaatattcctgtgttctattaataagtatagtaatcccatttgacagatgtgttgagaaaaatgaggtgttctgccaaaaatcatactcaagtcgagagtccactacgtatcgcagagcctaacatacttacattccatcatgctgtttctgcagagccaaatatttatatctattgttcagattcccaggcttcatgacagacaagggttttttttaaaaaaaggtgaaaacacataccaaagaaaagaaaaccaggagcaacttgtaagagtataaactctttatgtaaattctaccagttatattttctaacttgtaattaacgatttgcaagtcttcattcattcctttattcaatacataaagcatatttagtgagacctttctttgttcaaggaactttcaggagtagagaggagtaatctaaagatgtgtgaggcaagaagatttgcctttaagaaattgtaatttatctggcttttgttgatgatttgactgcctttagtagaaagagatgctgggatttttattaaaccaaccaactgaaaatcttaacaaaatataggcacatctgagaaggtggtggagaaatacagatttgttcatttcttatgtgagaatatggataatttgcttttgagggtgttggtatcaaacactgagaacaggagcacaggatcaagtaattagtttttctattaatgggaatgaatattgtcttcacattcatctttttgtccctattggatggcaaaattatgtttaaggaggaagtgacctattcactgtattgtttttgagcagatgtgagacactttaaagatgtaacgaggatacagttgagaattctaggtattacacaaatacttttaccttttgagagaattaatcttctatcttcattttgattccttaccagcatgagctagtctcacttgtatatagaggattgtaaaccttcttgccatattattgacacatgacagtaagttttcagtgagaaatgagttttatcttcagtttgacttatatcattgtatttatcataaactttggctataaattatcttagagaaaaattcgtataggtttcttttctaccatgacgacatacaagaccctatcttttggacaaacgatgtcatctgccctagacagtttttattcactcttaatattcagaatatatgatttttataaaatattattttaaaacgtgtaagaaaatagttattttaaataacagaaatataaaagttccaaataagtggttataacgaaatttgaattaaagagtaaactaaattacatttcattataattcttttcaggtaacagaaagaaagcaacagttggagaaatgcttgaaattgtcccgtaagatgcgaaaggaaatgaatgtcttgacagaatggctggcagctacagatatggaattgacaaagagatcagcagttgaaggaatgcctagtaatttggattctgaagttgcctggggaaaggtaaaacctatatcactgaaggttattttgaacatacgtgaaaacacataatatgattttgtaaggaagtattaacatgtagcaataatagcattataaatattaatattgtttcatattccctttcttaaaaattaatctgtgcttttcaggaccatgataaaaccaatggtaagctttagcaggagtctctccaaaagcttccttagagttcagtaaattatgaataagaccttaagaaatacataggtcattagtctgaaaattggtccagagatgagatcctataatgtactggcttgcctaagaccatactgcccagatgaatcccacagccatgaagagggcaaggacacagagattgaagacagttgggctggacaggacttgcaagattagcatattgccaaagtcgcatttcagaaagaatctcaaggtgtctatgcaggggctatcatttccatcaccaaatgacacagcgactcctgtaatcattagccgttaaattcttgccctttctctgatggccaatcatttcatgctgcttagaacttagtcaagagactcatagcttagtatttttttttttactgtttattcattaccagattacctgaaagtgtgttgatataaagaaaatagctgatattgataacatgttttacctcaaaatttgccactgtgttaggccatttacacccacttaatgttttaaagttaccaaattaactagatgtataagacgtttatactttatttttaattcaatgtggctatccagattattcaaagttgggaaattttcaataccttatgtaaaaacttacaatcgtataaatgagacccaaactgaaaactgtctttatgtagattcagagaacaagtagtaatatattttgttacataaaatatttccaaataaatagtagggaattaaattgtttttcttctctttcagaataaatgtaatgttagataagatattgaattatagttattcaggatcatacatgagattactatagcaaggaagatacagtatatacaggttaaaactcacattagccttattttttcttatcattcaaacatattacttgaggtatttttgcattagcctcaccatgaaatcattcaaatgttataaggtaatgacctttgcagaggtttctaggttatccttctcatatagaaggcttgaatagtctggagaattgtctgcttgttgaatctgcctggaaagtatttttcataacgtcaaggagcaaagctactgtgagatctagtaggaaaaaaaaaaagcttagaaaactggcatttattttctttctttatagaataaagataatttatcactctatctagatcttttcaaacactaagctgttaatgacatactctaaaatctcttagttgtcaaataaagtatattcatttgcatctgaattacagaacttttttttttttttaccaatttatttggaaggttctcattatttctttaaaaataacaatcataaaagaatatatgccctgcagatctaagccagtcacatttatgataatcattctaatattttaacataaaattcaaactctcatatatgaaaccccgtgactattgagtacattctcatttctcatggtttcttggtaggtggagagcttaattcaagctataagtttcatctgctgtttcaaaagataaatgtcacatttttaaaaactaaattaaattcatttaaatgcaatacattaaatgtagttgccgatcattccaagtatttggaatgtgactgcagcaaatttgaatatctagagtcaatttcttttttattattttaaaaaatttttagacaatttaatttatatctgctgaatttctcccagttctgttgacccaagaacattatatttattttcgtatgaaagtatttgaacatctagtttcaaatattcaaatacataaaaatgtcaattactcatgaagtgattttttgacctttagtttatccaaacaaagcataatttcaagtacattgactatagttaaatagtatcagttttatcttaaagtatcttaattatatttaatatatattaaattccagaaaaattatttagtgtggcttgaagagatacatatggcacaacttgagaagcctaaataaattggaaaactaggaaaaggaaaattatagtagataaataataaaaaattcttgcatagaaatatatccacaatgtatcatgggtggtggaatggacagggaacattttaaagccacaaattggcgccaagcttcctaaaagacaaaaccaagaagtaaacatatttttgagacccaaagtttccaaattattaaaataataattaaaataattttaactttactagtagtatgttagctttttgctagaacttagtgccagaagaaaataaatgggagggtcataaaggtgataacacgctgattcatattcttataataaacaataagaatgtttatttttttctaccaacatggctccatgaaaaagaaaaatttagtgctaaagggccattcaggaaaagcaattctatgagaggaaaaaatattggagcagaagtctaaagtagtctagcaattgttttcagattttcagattctctattttattaatttttaattttgtatggatacatactgggtgtatatatttatgaattataggagacatttttatacaggcatgcaatacgtaattgtcacatcatgtaaccttctgtgaatatgctttcctgcaactgagcttttaagtagaattagacatcagagatttgaaggttatttattttctctgaatacagaaaaaaattttctgtatctttttcctggaaagaagccagattgtttctaactgagaacacatttctatacttggccctatatctaattggaaagcagggcttcatattcatgtgtatgtcatagtactagaaggcttcaatagctaaaaatttttgctaacatagagttttgggtttgaaccagtcacagagaaattggctattgagccttttcgtgccaagcataattgaagaaagaaaactcaccatcgacaactcaaaatatgttgacttctctaggaacctgtatcaatctctcagtgaatgtatttatttgaaaacacagttgggctattactttagctgtaaaagctattgaaaataaagctcagtagtactctcttacttgatgatggcatttaaaaggtgaagtgagaatgttttatagggggcatgaagtatcaagtactgagtgtgatgaaaattaatatactggttaatgataatactgagtctaaatgtactagtttttcctgtgatatgagaaaactagaattcacttttcaagatcaaaattagcaaagaatttggaagtattgctccaattggagaatcagaagtcaccttaaaaacaatacagattttactaatctatagtaatatatatttcataaagtcttcatgtgacacaaaagttttagggttttggtttttaactagccgtgttatataatcgaggaaatttcctatcctaaattagaaaagtataagcatatttaaagttcaattcagtttttcttacattacgaagctgagaaaaatgaatctaacattaaaatcaaaagcaatctggtctggcttactgtattcatgtcaccaatgcggtttatcaaaaatccctgtcatatcaaatcaagcccttccacaatgatctaacacttaagtttttatgagaaaaaaaaaaaattggattctctatactcatttcacctccttaccgtggctgtgggcaggccccagatgatgcattgtctataatataaactatgttggtgaccaccaaagcagccaggcattcttgctgttccttcatttcttactagattatgttatttaattaatttaatagtatttcatcgcctatttatagggccatagtccatgtgcaagcagttttccagtaccaccaaaattctcaataaggtcccatcacaactatcatttaggcctaccataaaatacacagaattaataaaatgagacaaccatcattgtgtgagcaatacttaagtcagccccatgcaccttcagagaggtactactagcattgagatgaattattccaacttgtagggaaaccaaatagataccgaaagaaagagtttattcttatttatttattttgagatggagtcttgctcttgtcaccgatcctggagtgcaatggcccgatctcggctcactgcaacctcctgggttcaagcagttctcctgccccagcctcccgggtagctgggattacagacacctgccaccataccctgctaattttttgtgttttcggtagagttggagtttcaccatgatggtcaggctggtctcgaactcctgacctcaggtcatccacctgcctcggcctcccaaagtgctgggattacaggtgtgagtcaccacacccggccagaagagtttcttacactggccaaaagatcagttatgttctttataaacttggcataggcttagggggcaattcaccatttgttttctaatgctgtgccctttaaaaaggaaggggaaggttgcctaaaacgatgaaagagatgttataaaaatcaagcttcttgagaaatatagtaaaattggaaacaccttaaatgttgcagtgtgttaccatttacacaaaggataaaatatgtagaaatatacattatttagttatatataatatatagtaaaagcagaaagatgtttgggaattaatataaactgaatacagaacaagagctatctctgtgaggaaagacaaaagaattgggtgggatatgaacaggacacttaaatgatacttgtaatatttcattccttaagatgagttatgcatacagaagtaatgattacatttggtatactttctgtgtgtctaaaatcacatataagaacataagaaaacatacaaaagcaaatgcttgggatttttccttttggaaactccactagccaggttctgtaagataacgcttagtaattaaggaacacccacttcgtgagtattattggtttcaaaagagcatggccactgttcattcggtttgcctaagcattggccaaagattctcctgctgattgagcaacaggacaggaacctagcagattaattccagcgagatgaataaggaacattgtctttccagtttttaaagaggatgtttctgtggctttttttttctttattatctacattgaagcatgatcgacagattcttatcaatgatttccttgtgaaagcagagtcaagggaatgaatagcgcaaaccgagaactgagaattttcatcaaagtggaaccaaaagttagcctgtgtatggtcagtttgtgtggcagcagtgctgttctatccttaagaacacttctattcagagagaatcgttattagagaggacagatctgtaagtcactgggtgaggtaacatcagaactgaaggtcctctgaaaatgatcttatttccctttttgtaaacaagaaaactgtgcaaaaagctccatatccctttctctgtttctcgattactttctttttaaaattactttagattcaggggttacatgtgcaagtttgttacatgggtgtattgtgtaacaattctaaaattcatatggaaccaagaaagggcctgaacagctaaagcaatcctaagccaaaagaacaaagttgagggcattacattgccccacttaaaatatactacaaagctgtagtaacgcaaacagcataatactattacagatatagacacctagatcaatggaacagaatagagaactcagaaataaagctgcacacctacaaccaactgatttttgacaaagttggcaaaaataagcaacagagaagggacaccttattcattaaatattgctaggatagctggctagccatatatagaggaatgaacctggacccctacctttcaccatatacaaaaattaactcaagatggattaaagtcttaaatgtaagccctgaaactactaaaaatcctagaataaaacctaggaaaagttcttctggacactggcttaggcaaagaatttatgaccaagacctcaatgacaaatgcaacaaaaacaaaaattgacaaatgagagttaattaaattaaagcttctgtacagaaaaagaaacaatcaacacagtaaacagataacctcctgaatgggagaaaatatttgcaaactttgcatctgacaaaagaataatatccagaatctataaggaacttaaacttgtcaacaagaaattaaaaaaaaacagattaaaaacaggacaaagaacgtgaatagacactcctcgaaagaagacatacaagcggccaatgagcatattaaaaaatcttcaatatcactaatcatcagagagatgccaattaaaccctaaataagataccatctcacaccagtctgaatggcttttgttaaaaagtcagaaaataacggatgttgattgctttcatagggtgaccatgattacatttgtaatagtcattcactcctaaggatttcaaagtcatgtgggtccaggatcctcaatatgaggattaatgttaccatgggaaccatgaaaagagctgacctaataggggccatatcaattctagccaacttcttgagcttcctaatagagaagaatgcctaagagactctctcaccaagaggaaggcaaattaactagtcagataaatgagagcagagatgggcaaactataattggtaggcctaatccattcagccaccttcttttgtacagcccatgggctgaaaattgtttttatgtaaatggttggaaaaaatcaaaagaagaactagatacttcaggacacataaaaattattaaaaatgcatatgtcagtgtctgtacataagactattgaagtgtatcaatttatatttgtttattttttctggctgcttttgtgctaaaacagcagagttgagtaattgtgacagagactgcatggctcacaaagcctagaacaactactatgtggccattcacagaacatattcaaactcctgaactagaggaaagctaatatagaagcagcaccctgtttgaccatagaattttgccatgtcttcttcttgaatgagtatcagaggtttgacatttctgggatccttttgataggccagtggcgttgtagaattggtctttcctaaatagaatgattcatctaagttttcttcctgctcagaattaaatagtaacatattccaaaccatagatactagaatgcatagcccttccaaaagatactgggtggtgcgtgacacaatttaagatgtttaaagataccatctacttgaagagaattacgaactcaagaatgtcttaggtattctaattcttaatgatcccacagagaaagaatgggagaacttccagaagtagtgaggatgtggtcaggggtgattaactgaagggacagctgcaggtaagaaaactgtcctgtgtccccttaccctgtgaccatgtttccaaattatagttacagaaaaaaagaatatattttaaaagtattccaaattgtttaaaaggtaaagaaaaatttttaaattaaaatgacaggaggaaagccatttgagaatattaacaaatgagataaaagattgatgatgaaaattgacaatttaaattattaatgctaattgcaacttcctacagcgacatagccctttcactgtatttttaaattcacccttcaatcagagtagtattaaagagggtaaaattaatgttaagtttttaaaaatatggatcaatcctagctagctgcatggtccagacaacagcaatgccacgaggcagccatcacagtgatatttatcaccccataaatgttcagatacttttccttttctgttaatggaattttctaggctgaggtgacaaacactgatagctgtagaatagagatgatggaaggaaatggcaaggcaatctacaggagattactagcacctgaagagtttgaatactggaactgcacaagttccttgagctttcatgataacccctactctcttggactgttatgtaggcaatagtaattcattcagcaaaaggacagggaaaatgtgtattttggtctctgatatttcccatgtacataagatattgcctgacacataggacatactcatgaaatatctgtttaaacgtaacttgcaaattaagagttgcaaattataatgacaaagcagttcttgagagaagagaaaaatgctgatttacatttaaaattgtacaagttttataacaaacataaataatcacctgatcaaatgttcccgttttatagatgaacaaatacaagtcctggtacatagcaaaactgtaatactatgcctgatttcaacagttttttccactataccaaattatcataagaagtcttattttctagtaattttaaagtaatctaagcttaaaataacaaaaagctacttattcacaataagcatgaaacaaaccatggctaaatttcaagtgcagaaaatataagtcctcattaaaataataaaatgaaaacccgtgtgtatctatcacctactacagtctgtagtctgtccccactgttgtgattttagatttcaaatattgtttgttagtatcttaatatcactctgattagttgagtgtaagtaaatcaatctgaacatcccattactggccaatattgtttagcatatgaattgatcacgaaaacataaccataggaaagtaaatatgtatgtgattaattagaggtttacttccctgaagatcattatgtttgggaaatacaagctttgacaaagtctaatctatatgattttctgatttaatcactaacattttatttctaattttgttttaagcatcaaagattccaactcagttaaataatttagttccattaaacccctaaatatccatggtgtcatctgaaagttcaaatggtagaataagattttctggaaaaaaaaaatttggtcctatagtatgttcatcctaccgcctgttttattaacagtagtcttagtatgccaagagttgcctgagaggaacacacacaaacacacacgcacacaaatggtattaataaatttaactgaaggtgttaaatgcagaataatctatgtctaaatagccacttgtttaacaaattaccgtgtttttcacgtttattttggaaacaaagttttataatatttaacctcaggaagaacaaacattggttgctcaattatcctttggctttcagttcactcttagaatttaatgactatcactcaataaaaactcagaatgcatctttctgtttgcctgtggttttcaacattggttgcacatcaaaatcacccgagaaacttgaaaagtatcccaatgtttggggcccacttccagagattctgatttaattggtctaactctaactagctctcttattcagcaaagttgagaatcactagataatgtgatacaagatccgcgaatttcaagctgtctgacgagagcctaaattcagctcagtcaaccatgtcttgtatatatattttttataacagtaagatttcacagtttaaagagatctggtttctggtcctagattatctggataactgcctcaactcatcattcctcttagctataaaaatataagaactattacttactctaaagtctgttatactctcattcccctgaaaaattacgtatcttttttttttaaagtgagcagagtaatttatctgtgaagtgaaataacactagcagatcattaacttggtgcaatgaatgcatcaagcagctgttacttagaaaatagaacatctgttacatgccattggagtcactattcactgtcattatagttagagctgttatttctgttcagttcattctgctttcatgaaattcttctttaataaacaatacagtgttattaaaaagtcaatacacattgctatagaatccactatttaatgctttatgttctttttgaatgtatcattatattattctgtcacattagcctaatagtaaaatatgtcctaaacctctagccatgatagagtaattttgggggctgtaaaagcaattagcatctcatttcctcatgtttaagacatgttagattgtgtgatgcaccattgatatgattacagctgctgagaatttaaaaaaaaaaaaaaaaacactaccactttcaaggtaaaccttaattgtatgttacatctcaatttccgaatccttaaaatgtgacaaatgcacatcttagaattgcagtaatatggcaatgtattccttttctttccacgaatatgttacgtagctaaaaggtgaaagaaccctctcctgttctctgtgatcagaaatggtataatatttgcaaatactaagtgcagaattcacctgggtagggggacttctcaagatgccttttatggatgctttagttagccttttattcatattacagggaacatgagtaagagaaaggaatagctaaaataagtctgaatttaattgagtcctagtaaagggaggaatctataaggaaatgatgttaaggtacgtaggtaaataaatgtggtgctgattgaagataagctctagagaacaggagactcttaagataataaaatttgtttaaaaagagggggtggaaaaaagagatcagacagagaagttatcttaagaatataagtccctgagaaattccaagaaaatctgtggaaggtactggaaaacttgtgaaaatacgaaatgggtggaggagagaatagaggttaagtgagctacatttctttacccctgaagggaaatgtttgtaaaggtgttcctataggaccagatgatttttccaataatttttaccgttctaccattaaataaaaataatgaaaaatgctgatggtataatcagcagagaccaatggagaaggtttttccatcttgctactgtatcagtgaagtgagccgatagctgaaccctgaaccgaacatgcctttttaaatttctacaagcaattatacttgtagatatggggaatgaatcagaatgtattcttcatccttcccatcaacatggggcatgacttcactggaagaaattaactcattatactcattcttttataataaggaaattagagtagcatttacaaattatggctaagaagtagacagcaaatttgtttgaaatcatggaagttagtgcttagtatttggactatttatactggagctatcaaatgttacaaagtaacatatggaaaataatatgttagacattgtgagaatttatagtttaattggattttacttatgtcagatattttcccctctatcataaaaacccttagtgccaagtatatagtttgcgttcaccttctcttgaatctcctgaaggtggacttacaatcatgtcataggtcaagttaaaactgagtgtacacaatcttgctttttcttcagccctaaaatcgatcctagcagcaatcacattactacatgactgaaaaacctaaagtgtctgagttataatttagtgaatttagtcattgaatttgaacttgctccttcagaagagtagatcttctagaaccctctccacttctcacctcacaaggcagaagaaggcatgtatgctgagaatcggatgcttttgaaaaggaggaaatgccatatcttttcagctgtttctttccatctcgccaaccctataaataaggagctccctttgagaggaatgagtacaggtataaagacaatggccaaggcaatagctctaggttggttctccatacatctgaagatgcagacattcttgtgttgtgggaaactattagagccagagaaaatggttcgtcaacaacctcatcaaatgtattcttttagtttacagtaagaattccctgttcctctatggcagccttgtattctaactttcataccttctcgttgcttcgtactttgtctttagtcaatccaaaccatcccatgcacactccgccttcaagtgtcacctttcccttgtagtcattcatgcttattccagccatggctcatctgtttccaaaaaaaaatgtgatttttttctagtatgatatcaaattgttttattgcatttaagctttcctctgcagctacactgtaggcatgattagagtgaggtttgcaaagattacctcattcctcatctctggcagtgaatagcacagtacagactggatattaggcacctgatatacattggtcaattagtatttcagatctccagaaagcaagctcagcatagtatttaaaggctaagtcttatttaagtcttatttcttaagtcatatctttgattaaaaacacatttgagggaaaaatttaaggcctactaaattaacacaatattttttcctaacccaaaacagcatgtatacaaatgattgaatactggttccttattgttgaatagcatacataaaagtttaactctaggtctctttttttacagagtgtaaattgtcctgtgaatcacttttgaccattagcagttataaaccaccatcatatcactgcttttttcaaatacaagttgataatggtgataaattgaacatcttttagttttaatttataattttgtggaacttaagaaggcactagaaattagtccacatttcctattttgttcccatcaactgaacatcactggacattgtttaaattagctggaggaatttggccagatgttgacacataatggtttctgtgacccaggaactacctgcaacattatcccctaagttcaaaacttttgtgatctcttctgagttttggaaaattccattgcctttaattgcattgcttgtcatgtaagaaacaaaatctatgtacacaataactttttacattgatgctaaaatatagtgtcatctttatgaagacttattaagagataattagtaatccaaatataaattaagcttcaactttgtgaagggttacctttgtgaataaatcaactacagcgagatgccagtagactggaatatagaaagtagataattctcatttgcgtatatgtccatctctttgacaaactcatacttggatataagtttttgaaggatggggacttctctaccgttttatcccacagagcctagtaacaatggctaacatctatggttgtagaggttgtatactacaaaaggttgaagtcaaagtattaaaaggaataaaatctagtctatgtctactctgaagttaagctctaaagggtctgtatctacccaaatgagagacttctaataatctcccagaatatattgaggagaattacatatgattctgctacagtagtaactggcatataataggagctcaggcaacacttacgattgataaatgaagaaattgcttttatgaattgctaagctcacctgtgtgcaacaaatagcacctacatatgaagaaccccatgcatgatagctgtcgagttcatctggcattaagtaccttaatttcaggcatgtttttattgaaaaaatgtgacataaaaccatatcttagaattgaagaaacagtgtttttgtcttgcataaaaatttttatacattgtttcctcatttatttctcctgtttatccgatgccaaaggcaaaaccaaaacagaaagtatgagaagtgatttcgagtggaccaggaccttatggcgtggcagaaagacagccacaggactacttaggtatattataaagatagaaaagacatgttgagagtgactctatgaggccagcctatacctaatttcttactcttgtactgtaatttttttcttaagaaattagatgtaggctggcattacagagctgctccttgtgtgtttattaattgattatttgtatctggactttctccactttcctgttattgctgtttctcaatgattttgttttgctttggctttctgtgattaagacatcagctccactcgcaaatagcttttcaactcgagtgccaatcacagtctctgtatctgttaaccttattgagaaaggagaaaaagggtctgttgggctctggctcagctctctgtgaatgtcccacagctggctaactagacaggcagggaaagaaccaggcacagactcagtggaatgccgagtggccacattgtctgtcagccgtgccatgtaccaggaaaggggctttatgcagggcaggtagtaaacctttgtactaagatcactttttccatcactactctctatcttttttcatgttaaatgtgattgttttcatgttttataaatcacctcttaggaaatagtggtattctcttaggagattttagtctagggtatgtggatagaaataaggtctgtgaacttggattgggggaaaactttatctttatttgtattcaattaaaaccaaaagtaagcagttttttcagttaaaatgtgagcaacaaactccagcaatagagatacccatgactttgtcactaatagaaatgacagatacttttataacgtgttccagacattgtacatacttaaaaataccagttatgctcgtcatcactacattgaaattatcctaaagacctgatgctagatcttgttaattaacatattaggaaataaaacatgtattactacatcacaaatatttaaaaaatgtgttgcacattgtatttcagtataattgttttcatttaaaatcctatgtattttgttttatgcatttaaaagcattattatgagaatgggtttttaagcttcaacagatgccaaaaagatccatggcactaaaaggctaaaaaaatccctgctgcagaaatacagtagcaccatactgtagaattttctaagggcagtttcttatttgtggatggattttcaaatatctgcctttagccactacatgtataaattaaataaatataaatatatttagttgaacaatatgtatgtttattaaatatttataatgaaaaataagacatgaattatgcttatgtacatatatatgttcatagttacccaacaatgaagcttcagtatatatggtatggttttcatgattcattaatacatagttataggtttaaaaccttgcagaatcatagtaaccatacagaaagccgtttcataagcattaaatcttaagactacaagacattacttgaaggtcaatgctctccttttcacaggctactcaaaaagagattgagaaacagaaggtgcacctgaagagtatcacagaggtaggagaggccttgaaaacagttttgggcaagaaggagacgttggtggaagataaactcagtcttctgaatagtaactggatagctgtcacctcccgagcagaagagtggttaaatcttttgttggtaagagaaaaggctagaagcttttacacccttctctgtcacgagaaaaagatacataagtgaccagtaacaattctgtgtttgaaaatttctcaattctacgtatatgctggctcttaattcaatatctataacaatattttaatatatttttctttatatttacgcaatattctatatgaaaataccacttaaaactaatctcaatgaaactttattgttgtcttttaaacattttagaacataggaaaaattctttaagaatattgtctaaccaataatgccatggtatgtctctgtacaattaaggaataccagaaacacatggaaacttttgaccagaatgtggaccacatcacaaagtggatcattcaggctgacacacttttggatgaatcagagaaaaagaaaccccagcaaaaagaagacgtgcttaaggtagcaaataaaatatgaaaagtaatgtccaaattgtacaccagttacttcaatcatctttgtcctaaaagatactaaggacgtcttaataagagtaaaacaatcctttcttccttcctttatctttccctttttccttccttccccctttgaatggaaatgaatgattttgaagagttctgtaatctgactttctgttcaaatccatcactcagttaattatacccaatgtaaactccgttcagaaagatattccaagatttattttgaaatcatattgcaaatttctgcctttgtcaatggtggtactacattcttgtgtctaacacaaagaacaatctgacactatcattcatttagcccatctgaatgaacacctgaaatccagtcagctgatttttttgcctatgccatatccaaatcttggtaattagtcttaatgttgggcttatgtaaagctgaggttttcatttttaactacatgtaaactaggctttgggttctttcttttagtctcaaaactgactgttaggatgccctgtcttctttttcaaggggaacttaatcttttctttaaaaaatgattccgataaaagggtatgagaggtgtaatacgcaaatataccttatagacactacattgtttctatttgatgatgtctcttttcccaattaaataggtagagttgaattttaacagctctcttttcaataaacattttttattttgttttgctgcaatgtttgataaatttattgattagttgtttactatttaaagaaaactcaaaaattatgtttctttctatgcaatttatttttatgcctctgatattttccacagattacgatatacctttaatgaaaaactataaattcattccaggctatccccaaaacacatttatgccattgtctgaagcttattttgatgtggatctgtattgtgctcttcattatcccttgatgtatagtcagagatgtcatcttatggtgaatttccttcaaggctttttgaataatagggtctgagttatttaacttcaacctctgtgacccggcaggtcaggaagaacattcctcagtacctctgtatgtgacagaaaattcgtatgtgttagaaaatcactttttttcttatgacactcaatgtaataaagaggaacttgaaagtgctaggaaggaatagaaaagtgttcttcagctacctgacctcctgagcacatacttagttcattccacaactattaaattcagtaacgatataataaaataagactaaatagaatatattatgatagttgcaacaacatagttgggaaaacatccctgtccttcctcggactaaataaacattttaaatagacatgcatcaaacttaaggacggtgatctatttttctgaaatcacacgcattttcattttagtcctgttttatggaagttgtggttttatctccctttgtattttctgcatgtgcttgctctcattttcttactttctctctctctctttctcactcttctcgctcacttgctcactcgctctgtttggctctctttttctatcttgaccttcattaattactaacttcaagtcctatctcttgctcatggaatatagcgtttaaaggcagaactgaatgacatacgcccaaaggtggactctacacgtgaccaagcagcaaacttgatggcaaaccgcggtgaccactgcaggaaattagtagagccccaaatctcagagctcaaccatcgatttgcagccatttcacacagaattaagactggaaaggtaggaagatctactccaaggtggaaacttgtgctaaatggtctcttgcgaaggttgcgcagtactctgaaaggggcaagtagaccccacagcaaggttttcaaaaggaaaatgaatgccaaaatgtatttaaggaaattttaccactgattataatgggagataaacgccactcctccccgtctctgtctctctctgtctctctctgtctctttttctctctcatcttttgctgccatagatattctaggactgcattctatgctgcagtttacatacgtactttcaggggtcacctacagaaaaaaataacaaatagcatgctgaaggccaaaaaaataaataaaaccaaaagcacacaagtcatccatcaacataaagcactaccgataaattttgccaaaagcagtactgatacaatattgcttgtatgtaatgtggatcaaatatccaaaatgaggtcttgtacatcttctgcacggtctagggtgtttttttacctctttactggttgtgcaagtgtgtttgtttaacttgcttttgctagttgtagacactgtgacaaaattcattaggctataatgaaatgatcacgccatgaaaacaaatcattgcaaagcttacatatcctaatttttgtaattttatatgcctatttatattactgtttaagaagaaccagggaatatggaacttttgcgtgatagactttatatttgtgtatgatttgatgaagagaaagtcttatttaataagtagtttgcaaaaatgtataaatatagtgttatagaatttcagctctttgggaagatttgaaatgcaagtaattacctagaaatttatatactgtagtttgataaatttcaatatatatgatatgctttcaaacataaaaatgtatataaaatcaatatatgtatttaggtatatagataattgttagaaataatctgaaatgaaaaaaacattggagtatttatgagaaaatatgatgcagtatgtcaggtaagtattgattcctggaaaaatagaacattttcaaaaaatattttgatagatataagcaaccagtaatagcatggtttcacaattgctgcactttctaaggcattacagtgtctcatcatgttatataatagtacatatttaaagtagttttcaaaataagtgaaatgtgacatgataaattctaaatagtttagcttgtatgcatgagacacagttacccttcaaaattcaccttcccaaattaaaaagttgttagtttaccttaattcattgcaagttatttttaatagttaactacttagttctcttgtactctctctctccatacatagagaccttatatagttgacttttaaaaggctatattctctacatatggagagagacagcatgagagaacttagtagttaactgtcacaaatatatatatttgagtcagtcattattacctgcaaaaaaatgtgacaggctcttaaaattgattaaagttttgaaagaatgtattgttacttacaaagacaattgtttttacttctaaagatatcaatggcttatgtaataacaagacaatgaatggagatttatttcaatccttaaaaaatgctactacttcattactaagatatagacacacacacatgcacattttaataaatcactaagctatagaatatttaagagaaaataaggtattatctttggataaattgtgttacaagattgtggttcacagatattaaaaaatgggtagaatttgctctccaccacagatgtgacagacccagccaatacaagtttgtgaccaagacaagtttgtgagttttcatttcacattctgcatgaatttgtaagtatacttctggaaatcatgcataaagtgatccactctatgaacttcttttattttccctagaaacataaggcataagaaatttccagtgaatattcatttattattattattattattattattattttgtgtgtgtgtgtgtggtggagactctctctgttgcccaggctggagtgctgtggcataacctcagctcactgcaacctctgcctcctggaatcaagtgattctcctgcctcagcctcccaagtagctgggattacgggcgggcgccgtgacacctggctaatttttgtattttggcagagacggggtttcaccacgttggccaggctggtctggaactcctgacctcaagtgatcctcctgcctgggcctctcaaagtgctgggattacaagcgtgaaccactgtgcctggccccagattttcaattatatgttaattaacaaaataatcacatgtttgcttttcaaagtatttgtttttctctaaattagtaaaggcaactgagtgtaacaatgaccccattttagggctctgaagagataattatgctctattatcacgatgaaatgaaaaacacagaaataaagcatatctgacactttgcttatatattcattgcatcagctaatgggattgagcttccattgtgttagagattgtggtgagaagatacaagggtataaagatccttgcttaagaaatacatgttttcaaacagaaatgaatacttagtataatcataaaatatgtttaacactaattcatcttcatggggatgttcaaataatggtgagatgatctcggcagagagaacaatagatttagaaggtaatctcaccagagaaaacagtggatttagaagattgagatttaggcctaactttttcagtagtagccagaatatgtgatttttctgcatatccatttcattgtttgtaagatgaggaagttaaaatagactaacaatttttaaaagaaaacctatcctgcccaaaatattattatttaaaataaagtattaaatttaaatatttaatattaaaatcatattatttaaaattaaattaataaattggaaaataatagagttactagatgggggaaatatctgccattttatctttctccttcctatgattgaattcaggaagtataaattatgctcatagaacatggtttgaaatttctaaattagattagttcataaatccctgctcgttctaaaatttggctattcagtaatcttttgttgattacaataagaaattgaaaacatttaatgtcttgtgtgtgtttgctctggagtagggaagtgctgaagtgctggaggttttagggggtagcctttgatctcaaaatcaggtttctttatagtaggggttatacaggataatattaggttagaatatggcttttctatggttgagtctatgtctaagtttcatggaagagtaacctggggaaaaaaaatactatggtgataaaaaaagtagatttggattgaacacgggtaggtcatagactctttgtaatcagtaatttcagtatagcctttagaacataactctaaagagcccttgaatagagaaataacttatgctgaaaattcactggtgtctagatttactatttggtgaagaatacaaagtggggtactcccatgtctcctgccaggactgttcatgacaagaaattccgaagcccagaaagcagtgagtaaagggatcctcagttcagattggctgaggacttgactgtccaagtgcagctctctgtaatgttaattttggcctcagcaaggagcagtatggtgagagcaaaaagtccttaacttcaagacacaagacctgctttgagcactagctgagcacattactacttagtgattttggatatgcctctttacctctcagagcctcatttctagctacaaaataagggagatgatgcctgttttattttaatctaaagattgtaatgaggatcaaattatgtaatatatgtaaaaacatgcatttaaaatgtattaatcagtgtatagatatgaaatggttaaaaataattaatatcaatgggtatttccatcgttacgtatattacacttgaatggccgaatctggggggttgagacaaaaactgatggaaaaaaatgaaagaattgctgattttctgtggtctctgctgtaatcgactggagtcagaaaatcgtgtctttgctattttcatgacaaagaccagccttaaagataatgaagtggatgaatttaagaactactaaggagttatgtttgtcccacatacgccccttaaaatacataaaaatgctgccttttcccattttattaaggttacctaagagtatccaatgactttgaaaaaagcgtgttttttcgtaatctatgtgaaatcaatgtgaggaaatggcagttttaatggagaggatcagaattgcaacagtcaatcagagataatattagaaccctgagtaaattgacagaatcaatgaggagagactccttgtctcaactgtctctgttttagggcatcggagtatagtggcatggctgagggcaagtggataccatcgggaaaataaggtgataggagacaaaagtataggaaggggcatgggaagacaaaaataaactgattatttattcatattaattatgacagttctacccctctccatccctctagaagccaagttggagaaggggagtcagcaatttgggagagatgctagttgaggtatatctaaaagcactaatgagtgaagacttgagaaaagggattaatcaggatgaattctcaccaaccatatattattttccgataacagtgtttggtagtgagggggatctattgctaggtaaaatacgatggattcaaggagcttactgtttgatgatagggcaagatgtgttcatggatactagattgagagtgagtgcatggtaagtgagtttagcagtcactccagcaacacagaggaggtaacaattcggcataaacatatgagaaagcttaggagcatacagtgtgttcaatgaagagtgagttcctttagttttcagagtagagggcatggaagataaaacttagttgtggatgataaggctgaagattatggctagacacagtgtgaagaggtcatggacagccagactaatcattcatgcttaattcagtatgcaatgaagagttcttgatgtgctctgtgtgtgtgtgtgtgtgtgtgtgtgtgtgtgtgtgtgtatctgtgtatgcactgttgagaaattagtccagtgatagttgtgaggagaattccactgaataatgacatgaagttcgggagctattgcagtagtctagatgagatacactgatgacctcaaaaaaagggatagctatgggagtggaaaggaaatttcagtctagatcagtaaatcttttgtatgcacttgggtgaattgttaaaaccagtgtgctgggccccacactcagagcttctgactcactaggtctggagtggagcacaagagtttgcatttctaacatttttctaggtcagattgatgctgaaggtctagggaccacgcttagagaactgctgctgcggagatatttagaggtagcctagagttaagtcattacatacaaggacccaagaagatgatgaattcaaaaatgactccaaatttaactctgattgactaggaaagtctgcatataaattccaataataggcctggtgcggtggctcacgcctgtaatcccaacactttgggaggccgctgcaggcagatcacctgacgtcaggagttgaagatcaacctggccaacatggcaaatccccttctctactaaaaatacaaaaattagctgggcatggtggtgggcgcctgtaatcccagctacttgggaggctgaggagggaaattgtttgaacccgggaggcggaggttgcagtgagccgagatcgcaccactgcaccccagcctgggcgacagagtgagattccatctcaaaaataaaaattaaaaaaaatttcaataataaaatatgcatcaagttatatttttattgttgtaatacttagctgcaaaataattttgactaaacaaactttaggtgtgtcatattaataaaggcaattattttactttttacaaaatattatgtaatttctacataaaatttgcttagattgtatttttctagagatttagatatacttcactgttctaaggagctgaaatgttaaattatttattctgaaattgatactaaccagaaaaaagtgaaattattttctctgactttgatcctttactaagacttatttgctataggatatatctggcatatgttctttaatttccatataggccttgaaaattgctgctaaaattcatgtagcagtttctatatatatgtattacaactgtaatatgagatttggacaatcgggcatcaaatacttaaatattcattgtttgattgctgcaataattgtaaattaccaagtttttttttttttttttttttttttttacttccattcagtgtcagaagatataaaagtaatcattctttggataagagactttcacaagtttataggaggctgtgagagagtcagtgaccttcccatgtaatgtagaatatataagaaaaagaaacacatgattgggcctaatctatcttaaaatatggttctatgtgtggaaaataattaagcagtgatttaattattttggctctcctaaacttcggtgggaaataaatgatgcattttataaatgtgatctagaaggtccaatgaagatgtattggattgaaaatttttaattaaagcttaattttctgtagtcagatttatcaatgcaaatacattgatattttgcagtctctttctgatcgtattataacttaacacctatgatggaaaataatattgtatcttaattggaacagtattcttgctatatatattctttaaattttaatttttttaatttttgtaggtacattgtaggtatatagatattcatttttagtaaaattttctataaaaacatgaaaactgagatgaagacttgtaaatattgcataatttgtagagcattaaatatgtaatatttacaactaatatcttcaggtaatagtaacagatcactagtcaaactgtataatatctgcaaattttattttactaaaatgaatcagaaaaatatgaacctaacaacataattcttatgttagcttattttttccacatgtgtaattggttatccctataacaaggttaagtccattgaaacttcgctaataaatccctttggtaaccatgtaaaatatttttaaagtagatgtgtaattgagtttggtgagcagtgtcatttgataaaactatctgggtcttgttagcataacatttgaaataattaaagctatttggtgaatcttgattgttctcctttgataaaggaaaattagtcccctgatcagtgtcagtagatgtaaagcaattttgctttggaccagagactttcagatatttataggaggttgtgagagtgtcagtgagttgaccaagttctcacagttagacagtgtggttagcaaatactagatctcagtccattgctttgtccacttcaatacactgactcagcatagtttactgcctctatttatgtcataaagtagtttttgttggtctactatgtgttagtataaacatacccaatttcacttcaaatacagtgatttcgttatactttttgtattaaaaatgacaagaacaaaaggtggtagggaggaagaaatggaagaaggaagggggaatggaagaaataaaactggaaaacaacctaagtaaatgaaaagaaagtttaaaatacaaaattgcttaaagtgttatgtttttacttttgtctgtctcccccatacattttagagttaaatgttttcctcttttaattcatttcctactccaaaaagtcatgtaatcatgaaatagggcaatattctaagttaaactttataaaaggtcgacagtaggaagcagattcttgacccacgaatatattttgcatccagttttaaaatgtgtaagcatgaaattaacctcatccatacaaaatcaattgaaatctactgggtaatatcctctaattagcctcacaaattagtcacattttcacatttttattatcaaagcattaaaggtaaaccagtactttatctattctcaaaagaatgcaaccaatgaaatgtcactatttggagtcaatttatttaatttaaaaataatatttcttacattttcttgtttgctctaataattttaaaataatagaataaataagtttataaaccatattttaaataatctttcttctagcatagatgtagtatctttccaatacacttatttgtttttgtaagttcttttcctctacagatagaatgatgtgaaataactcttcatatcatatcagtagtctgtcttttctgtactatagtgtgttacttgtccttgaaatttttcatcttggtttccatgaattctttatttttctatatcaatattgtaatgataaataaattttcaaagctgcagaatggaaaaaggagactgatggatttgaagcaattttaaaccaatctgtagcacttggattatttattttcaatttaggttttagtgtgatttgaatatagtggtaatttatcatgattattaagattccatagtccagattaacaaatgtttacttgctgtctgtgtaaacacagtcgttattatgctagtgtatctgtgcatgccaaagtaatatttaaccaaggaaagcttacattttaaaactaataaagtgtatctgagtaattttgaatgctttcaatttacaatgaatcagtttgtaattgatcttgcttttcttcagtctgttatcctttgttaacttgttataaaattcagctttaatgccaaaacttcaacaaagccttaaatttcattaatccttaaataatccaacaaagcacaattaatagttgttaagcaatttgaaacattaaaaaatcaaggaaaacaaagtgttgtctttctcggtttctctgtctcttctttatgtgtccatttatccatttattatacttccctgtcttctaatttatatgtattttgtatgactgcacagtcatgctaaagctcttaaaatgaaaaggtaagtaaaaaattaaaagtgtccaaaacctatgcttggtatacactttctcatgcaatattataacttttgtttgattattttctatataactaaaacctattttgtgtgcactgtctaacattgtgtgatttaattgtgattccagttcttttgtggtcatctatttcctttaaagtcaatagaagtaacttacccaataattaagatgatttatcagccattgctttcaactgttttagacaatttatcataattctgaattgaaaagcaggcatgatatactttgtgttttaaaatttggtgactcaagaatgagctgttaaattataaacgctttcttattacatgtttcctttataaagttgcataagaattccaagttacaaagacagggaagaccaaggaatgacatgtagaattttaattgggtgggaaagtgttttctgttttagaatgggcatagcctaatgctgaactagtgaactcttaagaaaagcaatgaatttttttcatctctttgtgtccaaagactattaatcatatggctgtcaaatggctggtgctatcttgccaataacatagctaaaacaattggtttgataaacttattttggttataaaattggtcactggttgattaaattaatatataggtagttctaaaactaccgattgatataataagcaccttttcctgtataaaataaaaggcagtgttttcactggaaaatagagtagtataagacatattgccaactttaaggatggaaaatttatttagagagacaagcatatatctttgaaagccaaataatattatattcctgtctataagaaagcagtgcaacacaagctgagatacacataaatgagaatagaaactcctgaaataacaggtcaatcccactcccgtaatttttcctataccccgaggactgcctgaaaatttcactcagaacacataatgcaagataataagaccgacgtaagaataatctaaattcaccacaagttataaacaaaacattactattttattcaaagtaattatgagatattagttctttacaatgttatgagtataatggttaatagagctctatactgcctaataaggtggtcatgaaccacatgtggccactgagctttagaaatttggctactccatgttaagatttataaataagtgtaaaatatgtgtgggttttgaagagaatataaaatgtaaaatattcatatttttgtattgattatgagtttatacaataatttggacatctcagtgaaatcagtaaaattaattttatctgttttttgttttttactatggcaactagaatatttaaaattacatatatggcatgtattatatttctattgagctgcactactataaaagttctacttgaatttagagacaagaacttactgtaaggttataaaattttaagaaaatgtctgtgtgaaaaggattttgttcctaaaatgtgactgaatacatcctcatctagtctctgcttataaacatttagcattacttgaaaatcagtgtttttaaaaaaattgcagtcctcatcagttgttcttatataaacctaaaatttaggctccaaataatttttgcccactgattttagttaatcactttgaaactacacaaaataaaactactcaaattcttaatcttcctaatttttttaaacaaaatgcacggtagtctttcattggaaaatttagaccctacacattgaactaaagaagtctaagtttccattatcttgcctgaataattagcacttcagtttttggtagtctctcccaaagctctttttacatcttcccccttttttgtgtttacctggtggtatcatgttgcttagcatttgggcagcagttaatatacatactcatataatgctaaccagtcaggtcttttgacatttctacatagaaattgtgttatttaaaattccatgtcactaaaaaagctccttgaaatgtctattttggccctcaatttttagtcttttgttcatttattttttcaggaaatatttacttatgaatatttactatgtaccagaaatgactgtaggttgaacatgagaaactcagctccataggatgtctagggaacacaccccactgactgtatctgtggtatgccttttctgtctccaaataattcctgattaaaaaaaaaaaactgcaccctgtaaactaaatgcaaggctgtgatatcactttttatattgccgcagataaattaatctgtagttttgttcttcaggattatgtaactctaccaaactggaatctaaaatcctccatgttcaccattacaatgttatgatttcatcaaatcccttggtaaaataaagactcattatatcaataagcatgtattttatcctttaaaaccatagatttcaaaggaggaagggcttgacctgagccaatggatgattaggattttgagaggatcaaaataagacccaagatttatagagcatgtatttatattggatggacacatagaagtttgagagaaaataatagtcaacatttattaagcttttattatataccagacaccattctaacatatttgatcttagtaatagccctgtgaggtagatattcatcttatctccatgttataaagaaactgaggttcaatgaggataaataacttgtctaagttccctcagctagtaaatggtagagcccagattcaatctatgcattttcatacagaagtttatgttcttcactagaagatgaaaagtattctaaggtcattgaaggaggcataacagaagatcaccaaatggcctgcaaaaaaaggtctatattaggaacacttacataaggctggcaagtctttggggcaagattaggagaagccttgactactgtgctggaggttggactttattctatttatactcaatagatgcaggaggttcttcagcaaataaatagcataatgaaagaaaggtttttgaaacatagtaagctgatcattgggcacaggctggaactggtttgactgaaaggagattttacatcttttcaaagcttattgccttagttttgtgtaaggaccaggaacgatggagtctctgggaatacaaagcaagtggatcatagcaagtcaattgacacttacttgatatttattagacattagagtgagatgttcaaaaatagcatgacttacgttttacgcctgaatgactgagagaaatggtcttccattaagagaactagggaagttagtattgtaagcagtttgcgggaaagataatgtgctccatactaggaatgtgaaacttcaggtgaaaattcagctggctattggagagtctagatgggaattcaaaagtcagataacagcttagggtgaagacttggaaggcataaaaaattgttaaattcgtagaaaattgtatcttaaattaatagaagttaaattcatggagagatgagctagagaagaagcagttggaataaaacaggtaaatctgactgtaaatagacctatgttcttctgacatccaagtacacaataaaagttattttcaacattatcattatgtattcacaaaatcacatagaacatagttgctttcattaaatattagcaaatgtgaacaaccatttaataacataaaatatcaccaaattgataattgtatagttatgattctaagggttgttaatctttttacttttaccgtcatctaaacagtgtatgattttattgtaccgtaattgctaataatacagacattgaaactttaagcatgtttgtaccactaccaatctatactggttcaaataacttatgatatttcaaatggcaaatgatcattaggatttaaaaactggtactgtaataggtcacttaaaattatctcataaatctttcaggggtgtgtagaagtacctagaagatatgtggttattcatgttgcatatgagaatcatgtcatcatgaatagaatttgattattcacttcttcaatagtgacagattattacctttagatatttagtttttcttctacacttatccgtattgttcaccagaagttgccatctaataaaaattcaacctcttcctgggaatgtgactggagaagggtaggtggggaccaaacttgatgaatgtaatcgtcttggcaaaagacacgggggtcattcctgaattggttttacaaaagtaaaatgttttagctctgaaagaaaatcagatttctgtatgtcatctatgggttttcaagagctatcccatataaaatatgttctagtgttttaatggaaagaaatacagcataaagattgagagagtatcaatgtattttattaacagaattttaatctaataactaaaccttgcccacttttttgaatatatatttgattttccatgtcttttcacttatcactccttttcaagggttttgtttagaaagtcaagagattttaaagttttcttagactggtcattatcagttcaaaagtaaagaaactgatgtttacaaggttgaaaagcatagattctttatgtgaaatatattaggttcattcgtttgaatttatttgcatcaccaaccaaactgttcctaaggcaagctaatggcattgtcttagaagagcatgcctgtcaattgtgctgtgctaaaaatgtcatttaaaacatctgagcagattgccatgtagtttttctaaggataagatgacaattctgcatttctacctgaggttactgttacttgataaatgaggcaatttctgatgagacatatttacccaaatgtatttatatcagaatatttaaaataaggtcaaatttgactttagaatattaaaaattagcccattcaaatgtatctgtaaattgactgttgttgatatcaccaaatgatgaattgtactatcttgcatgtatgttcagctctggtgatgtgaaatgtttctccttatttgcatcctcaggtacttttccagttgtatttcaaaacccttcataaaacataatatggaaacataatgcatgtgattagtttagcaacaggaggttgaataaatgtatttcttttggtttatgtttctaataaaaagtaattttgatttaaagtagcactatctttttttttaggcctccattcctttgaaggaattggagcagtttaactcagatatacaaaaattgcttgaaccactggaggctgaaattcagcagggggtgaatctgaaagaggaagacttcaataaagatatggtaaattggttgtgataaaagtgtgaatgaactaggagtggaaataaatatttggaaagaacttagataagtctccaactgaattttcagagcacatattacacattttatgattctaatgaattttataaatgcagaatattcttggccttttattacaaatgctgaattactatggtatggtaatataggagcacttacggtttctaataaatagcccagcaattttcttttgacctgacctacttttgaacttatcaagggcaaaatgtaattggaaaaaagagtcgaatcataaaataaactaaaaatttaataaaatactcaactatcatagatgactgacattttgtatcagcaatgtttttggtagtataacatttatttcaatgaagagagaataatgcataatatgaacattatttattacaatttcccacaaagttgttttaccaaatagttgtttagttagtacattatatgtctaaaatgtgtataaattcatgctgcttatttcatgggagtaaagaaatatgaccatgtgtgctcttcccaacctcagaatattctccttcaatcccaactaatttcaaagtatctactacatttctctctggcttgaatatttgtacatcacatccttattaactgactttttttttctctcttcatcctccttttcacaattttttcccctctttcactgccatcacctctgtggcattcttaacctttacaattaccagtgctagagccttctcagacaatgcttgaaagtgacatcagaagacaatatataaattttaggtaataagtgtgtgaagcaataggagaactattcccaccaatcttagttcccacttcctggagctgcctcaatcaatactccccatgtatggggtttggtggccttgccaactcagcttgtggaaagacggaagaggctttccaagttgctgagttacagcaatctctacttcaggtcaaagaagaaactagagggcaccaagatgaaaaaaagtactgattacctcttgggctgaccccaactctgccctagagccctcaactggtatagggaaagaagtgaagtgggttttttaattttttgttgtttttgtcctcagccctagaaaatgctacagacttttacaacaccttttaaaataagtaaagtcttttacagactataagtatatgatgtgtctatattatgataagtatataatgtgtctatattatgccgtatgtttctttagattattgaccagtctctgacaaaaataatccctttcccccatacaaaatgaatcagtcctcagttgcgtgttgaagtttatgcattatagatttaaatatataacatctaattccttgaattgtaatacacacatacaaatacttgtgacttttgaaatttattatttgttttccttatgtcatcagtgtaccttgagtaccattacaatgtgagactacttgatacaaagttttcacattctgagttgaaagaaagaaaactaaaggtgaaaaatcacatggtcatatatgcgactatattagaccagcatttattcaaaacattttatttctaagtaaagaaaattaagatattgttcttgcagcctaaaggaacaaaatacccattgaaaatgtttaaagccattttccagtccatattttagtattatttgatcgtatttaaattaacatgcatatatgacatattttagaaattatttgatggtaacttagcacatgatttttattaatatcctgatatttctcctattaatattgagcatttaggtttcagaaatgaagcaggagttattagataggaattagtgtacatttaaatcaaaatattttcatgtagttgtgtgttaatattttcagatttgctgttatctcagtcacaaatacacatctgtattcctttatggatcagttaacattataaatgataactttagctcatttctctaatgttttaatttctagaactacactaaaaaagccaaaagaatactttcacagtaattcatgacttgtctgacatgatgaagtaccacactcccccatctttctacaggtgcccctaaaaatgtgttctttacaactagatgggaggaaacttattttgaaacctcaagtaccaaatgtaaaagaaaggctatgagcacagtatcttataatagcattccatgaaagttttaaattggatttttgtgtgtgtttaaataacatgtcttattatctctgttaacaatgtacagctttttaaaaaccaaaatgaagactgtacttgttgtttttgatcagaatgaagacaatgagggtactgtaaaagaattgttgcaaagaggagacaacttacaacaaagaatcacagatgagagaaagcgagaggaaataaagataaaacagcagctgttacagacaaaacataatgctctcaaggtattagagctaaaattataatataccttgcctgtggtttttttttaatatatagggtaaaatataatgtgcattaataaaatctgcttcagacttagtcatcagaaactcactttttctgttcaatgtgtatgctttatttaacatttttgagtggtatttgattttgaacgatgtgttgcttaaaagttatggctttttaaagacatatttttctaagtagtaattgaaagatgggaatgcattcatagtacttatacatttaattttctaatgtgctttatttttatcagctactttatattgaaaaaaacctgcctaactgccagaataaccgatctacatgtatccattattcctgctttctttacttaattgattttgcttgcattaggtccaattttttggtaacctgatacttgtttaataagccctagattcttttatttatttttaaaactttattatgcctttaagaaagtcactctttgcaactatctacaaagtcaaatttcatttatgtaggaatcctaaaaaataatcttagtgcccttgaataagaactgctactttcatattaagcagtgtagtgtatggcttcaagtccccaggtgactcatctggtttgtgcaggaagagcaggataaacttaatttttctataataatatctaggaagttcttgagactagacatgtggaaagttttgtgaaactttttttttgtatatgctttgcaataatcactatttgcatgcatggctgattttctaatacttttaattgctgagcttttccttgtaaatcactcttttgagctatgtagttatgaaggtggatccacctagcaggtagatggagtctgctttctacatgcaaataagagaataaaacctttccccctatagtcaaccaaataaacactgctgagaatgtaattacacaatattgtgcctgcaaggaatccacaaggaaagtctaattggccagcaggtgttctgaaggtaactgctgataaatatagtaaacagaaaaggcctcttcctcgagggagtgcaaaagcacaccataatgtgtctagaaaatcggaacgctatgtaactcacacccttccaactgtgagcaagctttcagaagtatctacactggtcgtatgatggtgtgtgtcctactgaatagcagtgtttaatggtcatctggcattcctctaaagaaatctacatgacatctctaaatattttacatattatacatcactttgtgcttaggaaatgaaagatgtttcagattgatgaccaccaagccctttctcctggcaaagatgtgagttatgtcacaaataaggcatggctcaactctaattcacgtggctgtatcttgctacctttgaaaaaagcagcgttcgatctgactcctcagaaggtttgaaaattcaacataaaacataaagtacagcaaggtttaaattcccaattttaaacaaactagataatgaaatgtagttcattcttgcaaatacaggctataagtgattaatcaaaatcgtcaacactactcgccaaaccaatctataccaacatattcaataactttttaaacctgtcaaatagttccaattctggtccttatgaaatattttagagaaggtcaaaattttccaatggaatgaaatttttagaaattccctgatatttattattttttcgctcgaattaaacctgtgaataaaaccctaattgctactttctgtagaaatgaaagctgcatgcagagcttatgttcccatgaattataaaatggcattttgagtaattctattaatcacagaagatattgagtgtgcttgtaaagagcatgatgactgatttcctcccattgttgatttattaaattagtcttatcacattgatttgaaagcatgcacttgctgttttcttttttcaaatagttaattgttttgcatttagagcatgatttggtatagtaagataaatgtggctatgcaagccttggaaggagaagcatttatctcacataattttttattagttatgttcaccaatatacgaacagtggtgacacttctacacatacagcttggaacagtttataagacaactaaaatggctttatatttctaatcataaaatattaatggcctatgaaactcttatgtaggcatttctaaaaacatgaatgtatattggttgagtacataaagttttgttgatgagccccaaggctaaagatatacattttagaattttacctattttaagtcagatacaaactcactaggtttgtgagtttgtatctagttaagtcaattgtattcgtatattaaactcttgcacataaactacacaacagttagctcattaagagtcaattgaatgtgacaaaatttttaagcaagtttgaacatgctaagagaaaatactttaagtgtgttattcaggtttcttagcttcctatacatgggtcccgcctcatgcataggcaatttaattatgtctttgtatattttgcatttaaatatgattttaacctaagttgtacaaaaagatgagggacgcaaattattttgataaataactgcagccagaagtgcactatacatatatattgatattttaataatgtctgcaccatgaacaggatttgaggtctcaaagaagaaaaaaggctctagaaatttctcatcagtggtatcagtacaagaggcaggctgatgatctcctgaaatgcttggatgacattgaaaaaaaattagccagcctacctgagcccagagatgaaaggaaaataaaggtaatgttgttttagaatgtcaataccagattttattatacagtttaattaacctgtgaagatcatatttaaaatgttgatgttcttgtttctattaacgttctctttgatttgatgcatttccttgtattgtgtgttgttttcagtaaatgtattgtattaagtgttattcaattgacgtaatgttgaatgaataaaatgttttagactatgtaaagtgatttaagaaatgtgatgtgttttctggtaaaattgtaattgactttgtgtatctttgttccagatgaactaatgacttatcggtatatggacgacttcttactcatgttagcccattcatttcatcagagcatcttcacacatcagtgttcactctctatagatttatttgcatattgtctaaatatgtttttttctgttattattttacactttttattttgcttcattctctgttgagttcctcaaacctttaaaaaggaaataaataacttattcacttaccctctaaattatattctatgtggacggtccctaataaataatgagttatcactccaaattgtttcaaatcccaagacaccagaggaatttagaagaaagaaaatgttagaccaatttcaatatttacttaattagaatatctaaaaccaagcattcaaaggataactgaaataatatttgggttattgagcgaggatgacagtcatgcctttcatatttgtaaacttcaaaggatgacaataaagggacaacagcctttgaaattttgagagaagtatttgctgcttgcaagtcggttgatgtggttagctaactgccctgggccctgtattggttttgctcaataggaaattgatcgggaattgcagaagaagaaagaggagctgaatgcagtgcgtaggcaagctgagggcttgtctgaggatggggccgcaatggcagtggagccaactcagatccagctcagcaagcgctggcgggaaattgagagcaaatttgctcagtttcgaagactcaactttgcacaaattgtgagttgttactggcaaacccacgtatgtgtttgcaactactactctattaacagaggcctactaataaaaaaaaaagagacaaaaaatctgggtacagttttaaacttctaatgtacattctgaaagtgagtggtttccctcactttgggcttctgtaacactagtgcttaattttgccaattaaagacacaagaaattaacagataacagggaaaaccccttatcaaaaatgaaaatacatcttaattttttttgctacatcatttttcataacattggcaatgttaatttgtcaatttatcatacattcactttacttcaatgtctaatccaaaaaatatgtattgctttcctgagatcatcccatgctgattttactttcttaatgtatacatgataaataataaatatttcatggtacatcttatgtcaacctgcataagccattatctcattgacttgaagaataatagcttaatcctcacacctggtttaactacttaatgggttacagtgcccataaaagaactggatgcctagtaagatggttgctaattgattgcagattgaacaatatcagataatgttattactgaaatgttaccagccaaaacaaaaaggagtgactgctcttctttcaaacaactgaatggaaagtgtatggttctctctttaaaaaggcgattcagaattgttagcttggtctcacttctttatttgtagtaggtataaaccatagaggttttctgacaggtacatttttgttcctattattaacacttgtaagatgaagaggaatgatcatcatctgtaattatagaagaaagtactcctcacaaaaccaggatgtcaaaatctggaaactaagtctttatagttaagttaggttgaattatatgaatcaaacagatactcaaccattttgccctatgtaaataataactgcatagggttcagcccatgtatgagacttcttgggaacttcttctgtgatagtgtcagttccatttaatttggtgtatatttttaaaatgtcaaaagcagttaccataacttaattttataagcatataagggaagtatgttgcatattattgtgacttcttttaatacttcaagaaaattaataaatacactgttttctgttaaatctaataccctaaagtttaatagcaggtgaattattctgagcaattggaagaatacgagaaatagcgaaactgtattgcatgtgaagtctaattccacctggctgaatgtttcagcctattatccttcatattagatgttatgaatgtaatgtgtcataaataaccttacactaaccagcaagcctgtgtctgcagatgcaaaatgaagcgaaagattaaggcaatcaaaaagaaaattctaataaaatagtttcacctcaatttaatagatcattcaagggggagtcctttgctttgaattatctgactactaactcatttctccattccaattttccccaggtcttgacacacccaatatgcaggtttaaaattcgttacaaactaatcaagttgctaatgctttatggctaaataggcacaggatcaaaaatctccataaaccacttacttaaaatgccattatgtccctattcatagtaggctctcaacaaatatttgtacaacgtaataatgactggtgaaataaaggaagcatgtgtgaaccagtatatatttttaaaaaattgtagtaaaattctgggatatattttcctcataaacgatttattcttaagttttatatattaaagatccaaaattcagaatgtgaagggggctatttttgtgttaactcttaattatccatgataataaagtaatcacaatctgtatgaagaataatcaatttaatattgcagttatatttggcatcgtattttaattagaactgagggataattgatagatgataagtaggtatataggttggtaggtagatagatagacaggtgggtgtagaaatattcaagatacatctttatacttgaccaattgtcaatgcattttaaaactaatttcactgtggccactgattagagttatctttcccaattcttacgccctagagtcatttgtgatagtcacagtaacagcttaatgaaaagtagtatttgatataaccttacaatggctctgatgcagcatatgccatagcttcagaatttcttacctccccctatattctccttctctaattgtttgatttttacttttcctaactgtccctttttgtttttctagatataaactgtaggcttaaagttcatctttcatgtctttacagcaacatgttgaaatagtaagcggtactcttaaaatgcttagtatgtgagagctgagtgagtttaaaatgaaaaattaattttccttatctcacagataaagactcagagaagtgctaaccactgtaaaattaaggcatttaggggactctgtccatgtcagagctatatatggtagtaataaagctcagaaaaggactgagactttgagggaacaatcatgaggcagcgcccagccacacaggaatgcagaccaaagcatagtagagggtatctgcaaattgtggtcctcagggcaaacctggagatgataaagaaagaggcatgagactgggaggacgcaggtaaaaattttaccagatattcaaaatgagagaactcctgccttaattaggaattccaatcatttctaatatatttcctgttggtttagaaactaggttcctcagttaagaccaagcacggactgtaaactgaggaaaagggatagttctataggatgtactatcacagcagtgtggtctagtaaaattaactcttggataaacagccttgaatatgaatcccagtgactttgagtgctgtatgatcagggataaactgagtctcatttacttcatctgtacaatagagataaggatgtttctgaggattaaataaggtaatatttgtcaaacacctgctgcgttatgcaggctcaatgcatgaaagttttcttcgtctcctttctgtatatatattaacattggaaaatagacataatctttaatttttaaaatattttcataagtcattaagagaattaagtacgcagcatttgtttaaaatgttaacaacagatatctcgttcagtgaaaatttcaaatttaattctataatatataagcagatacttttctctagattcacagaataaacacaggaaatatcacacaaatctgatgactgccaagaaagggcatgattttccctaaactgcccctcacatcattgtagcatttggaaaataacctcagagagcccaggcatttgcaaacacaaaattatacaatgaagataccactacaacccccaagggtcatgtgaaactgctaaggaacataagcttacaaactaaaattatgattattgtggaaaaaaattataagcaatgttatcagatgccaaacgttaaaaggagaatgtatacctgaagaaaatagagataagaggataatcaccaaaggatattaagtaatttttaatgttcaaaaataaaaattaaatggatttttttccagtaagaataggccattatataaagtgaaaacgaagatttgaaaaaacaaagtctggaaatgaaaatataattaatccctcaaacatctgcgtgaaataagtttcaagttgaaaaaaatagggattatggggaagagacaatatttcatattaatgaaatttaataaaatggaataaatgtaaattttaatgaatcctcaaattcaataaaggtcaaccaacgtggaaaaaataaaaacaagtctaccagctagctctgaatgaaactcagagcatcagtaatcaaaaaggtatcattaagggttacttaagacaaaagaacatttacaggatgacaatattgactgaagacttttcatcaacaatagatattagaagacagttgaataatatcttcaaaatgctaggcacattttcaaataccaggtaaaacatgattcaagaattaaggcaaaatattctcagacatacagctagtttcacctgaacaaaaactaagaatttcttgtctatagatttttgctaaaataattactaagcaatatatttgtgtaaaataaaatgaaactagaaggaaggagacagcgatgtaaagctgtataaaattgttttctctgtaaataagaacatttattaaaaaagcttataatcctaaaatttggtcagtgccaccaaggaaaacacagaatactaggagaatgcagtgtttgactgatcctgtgtaaagagagagaaatcaaatagaagacttattgcatatcctatgaattacatatccttaattcatatcctgcatattacatatgctatgtaaagggagataaaaacaagacttattcgagataatggcaacaaatataaggcttgtgcataatgtgttctatgtaaattattaccaattataatgtttctagatagcaaaaaagtgctaaacctctgaaatatgtatacatacatgacctttccaagaacagcagcaaaaaaatacaaaaaaaagcccacttcagtgaagaaaaagaaatgtccattttctaaatacatttccacttgagctgagcatgttatgacatcaaataccaagtatatgatcttgatgtttaacattttatatccaacagtctcttatcttggatgcctaatgagcatctcaaacatacaatagccaagtgaaaaataaatgatccaccccccatctacgttaattggcatctaccaacatctccagatgttattaaattgcactattatttacttaagtcagaaacctagacatccttcatgattcttttctcttacattaccatgtaaattatttccactcttgttggatatacctgcaaaatgcatcaaatcactcctccgtatctgttatggaagtgctaatctacaagattattatctctcatctggattacttcaacaacctctaacctcttcttccagtctttccccacttacaccatatttctcctggtgaaggcagagagctccttctaaggagttaatgagatcatatcaggcccctcctgcccattactctttaaatgaaatcctgtgatccgctatatgatgtagccccttcctatcacttctgttactcacactttgtctccctttttgctcttctgctaacatagaggcctaaaggtttcttttctatacttaaacacaaccaatttcatttccatatcagtatctttgaacatatttttctaatggaatatttttcacctagaattttgcataggtgctataacttatttagatatcctttcatttaggaacaatgaatatttagtagaactttgatgtataatctggttatgtaatgtagtagtttctgttataaatgttttatattccctatacttatgtatgcaaattcggagtttaagactgctcgttcagaacatcagtttctcttacggttacttctagaagtaggcatactaaggaaagacacagcttctggaacataaaagtgaggtggtaaaagatgaatatgaagagggttacaatattgtattgcaatggatagcttgtcctacagcagagtaattgtaatgggatattttgacaaaattaaagtacacatttccaaaatatacatgctcttggaaggctgatagaaaattaaccttgtttgtagattaaatgctgcaataaatgtgttatttaaaatagtccttggctgggcgtggtggctcacaactgtaatcccagctctttgtgaggccgaggtgggcggatcacttgaggaggagttccagatcagcctggctaacatatataacatgtcatgtatatatatgacatgctatacatatatacacatgttatacacacacagataacatgttatacacgtatgcacatgttacatataacatatataacatgtacgtatacacacgttatatataacatgttatacacacgttatatataacgttatatatacacgttatatataacgttatatatacacgttatatataacgttatatatacacgttatatataacatgttatacacatatacacgttatatataacatacacgtatacacgttatatataacatacatatatacacgttatatgtataacatgttatatataacatgttatacacatataacgttgaatataacatgttatatatgcacgttatatataacatgttatacatatatacacgtgttatatataacatgttatacatatataacgttttatatatacatgttatgcctatatacacatgttctacgtatatacatgttatatatacatgttatgtatataacatgttatatgttatatatacatattatgtatatgttatgtatataacatgttatgtatatgttatgtatataacatgtttgttttataatgttttatatataacatacacatgttatgtatataacatgttatataacatatacacgttatatataacatgttttatatataacatacacatgttatatatataacatgtatatataaatgttataaatacatgttatatatacatgtatatacatatatacatccatatataacatatatatacaagttatatatatatgttatatatatgtattatatatgttttatatataaaattagccaggcttgctggcagttgcttgtaatccaagcttctcagaggctgaggcatgagaattgcttgaaactgggagacagaggttacagtcagcagggatcacaccactgcactacagcctgggcaacagattgagaccccgcctcaagaaaaaaaagtagtccttaattgaataaatttgtaaaataaacacctatatattgtgaatatttttccactaacttttttaagttgtttgaatctgaatagtattatacattcacaaagagttttcacatgcatctagtttgatcacagtaatgaccctctcaagtatcattttctttgtcattttactgtaagaaaaattagcataaatgaggttaagagatttgtccaaggatacatctgagaaatggaagacgccaaacttgaactcactgctttccaaaacatggtgggagttattaataaaaaaggaaaaaagtttcagtgtttaaacaattttggtaaacagtagattaagcaaactttccttactctataactttctagtgcgtttgatatgctaatgggattatgactttctatgaaggggttagattctatagactttcacatctagacagttgcagtagaaaagggaaatttgatttcagattgatgaaaggtttcttatttgagtgatggtgaaataagaatattctttagaaaaaaatgggaagaacatcaccgtatcattattcttctgttgtttgggatttccttaaatttaagcagagatgtacaagaaaagtaataacagaactgtttgccaccaccttatgtaaaataatgtctgagcctagatttaatggtctgctacacattttttatattgtctcctatcttgtaataaaagcaactcattttgagaataaaattaggggaaatatattgtctttgcataattgccacatagattttcttctttgccttgaaataacaacaaagattgtcagctgccagtgcaacatccttggagaatttgggaagataaatgattttcttatttagagacagaatgttctttagcaaatggaattgtaaatacaaaagactaataatggttgttaagggaaatgttgcaccaggatgtagctgtttgtagaatttttctcctctcagctcaattttgtaattaacatattacaaggattaaaaaagaaattagctaacattttatgtttttctagattgttgatgatcatagtggttataaatatttgtacggagtttttttgttctagtgtctagttgtgtagcataatcagtttaatggttaagtagaggcatgttcagcgagtatcagcttccagaaagatgacagactgacttaattcctcaccccctcacttcaaatgcgtggaaattctgaataaaatataatttttaaaagttttaaatacacagctgggctatggtggaacctctcttccctctgtgtgccatgaatgatcaaatcatcttacgtgaaactgaacctggattgagagcctaatggctaggaagaagttttcaagaccttttaggacaaaatatgtgaccttcaacaacacataatatagaggtgaaaataaaacccctccttaaagtctgaattttcaagggcttccctcagctgtaaaggggaataaataaatcctacccacaatggagaagaggcattatctgtagtgataatagcttaggattttcaaaacttaatagaaattccaatactccgattgggaaactgagcaaatctgaagcagaaaagattattaaaaaaaagaaatataagtatagatcatcactatgagacgatgaatctgatgaatccaaaaaaagcaaagaaataattttaaatactgctgtatttccttagaaagtagtgacacttaaaatggtacctggttttagagcaatgatagaagccagaagacggtagaataatattttcaaaaacaatgaaagaacatccacgtaggaacctagaattgtgtactgatagaaactctctttcaggaataacattgaaataaagatcttttcagacacacagaaaccgtttactagcataaaattccctttagaggacgtcaagattggtctttaagcaggagaaagatacaagatggaagatttaagctgcaaaagaaaatgatgtgcaaagaaaatggtaaaaaaatggaaaagtcttaaataaacatttaccgtgtatgaaagtgtctattaaaaaacagaaaaatgctggacatcaatgaaacatgagaaggtggttaagtttttcatccagtttacctgctacctttctatgtattgtttctcagtttccataggtagtacctacttctctaatgctgaaatgcctcagtgctcagtccttgggcacttgccatttttatttattctatatatgtcttgctgttttcatccagcctcgtgacttgattaaaacaaaattattcttttcccctcaaatgcagtggaagcaccgttctttcaaattttcagagaaaaaaaaaaatctacgcatgctttctttagcctatctctacacaatacacagggacaacatttgaaaaatataaaccatatttaaatctgatcataatccttcaatgaattcccatctatttttaagtgaaatccaaaactcttcatgaatttcaagggatatctgacctggctggcccacttcttaactcaggccttatctcttaatactttcctctgctccacctatgttgacccctttgctgctgctttcacagatctgacatgcacccattgcattgtgtgctacctctgcctaaaataatcctcccccgtttctccatgtggctcttttcgtttctgccttaacttctttactcaaaagtgtttttttcaatgaatctttctcatgtgtgcacatacaccacacacacacacacacacacacacacacactttttatccatgctttcctcatttatttttctcaataaagtgcatgaccaggaaagttctcaatattttccttctttatcttcttgagtatttatttccctacctagaagtagagctccaacccaacaatgcaaaaaaaaattgtctttttttcccactgctgtgtcctcaacacccaaaacagtgactaggtacacagtatatatttgtttaattcataaaataagtaattaatcaataatgaataaagcaattttaagattctcttagtgcttagaatgaaaacttgcaaaatttcttgtgcgtgttaagaattttatactaatcattaaatcgatagaagtatacaatttttgaatagtagagggaaaaataaagacaagctattaagttaaagcaaataatccaaatagaaaactgaggtttaagaacattaattgaattcatcaagggtagtaagaaactatatgaacataggattttgtgttttccgaatatctctagtccaaagccatcactatgtataaaataagatgttaattacagtttaatattcttgtaagtttaagcaaatttaccatttatacgtgatttatacaacatattacctcttgaatattgtctcaaatgactggcttcaagtagcacgttaaataaaaatagtagaataaatgtgtcaagctacacttactattcacaattattttatagttagattatggctctgttagatatacaattttatatttgcttatcttctgaattaatgttacagtaatagactacagtcatcatgcaatgtgttgtcaaatatattaataaacataagaaaaaacatagtaatatactgtgtcaaatttttctatcaagtggaaatttagcacattcttcaggaaatattgactgcaaaatctatgattaatatatttttcagaaatattggatataaatacaaaatgaagtgatgaattattgatatgtgcagttttactatcatataatgttactgataaaattaaaaaaatataactcatttttagcatcagatgaggaaacttggttcactaaagttagtattatctttatttgaatgctacaaccttgaaaaattattacatttgatagaactatttgggaacagtttgttacttctcattgtgactatggacattaatgggatgcccatattccttccattcccttttcttagcatagtggaaatgattacagatatcagttatgtttcttgactgatgttacagtcattccgcattatgaagtatgcaagactaaatttttacaaagggtatctcttatccttatgatagcctaaaaaggtgaaaatttgtcaagcaggtttcctaagatcctataaaattaggggacagggttccagcatcaagatgtagttttacttattgaattaacacagagttttgttgatgattttctttgatgatgggggtagtgatcgtggtattgttttattacattggtttcttcctttttttgttcatttttaatgggaacctcccaataatggtgaggatgcagttaaatggtaactccatacacttagtgtgagtctagaaataaattcaagttttattttgaatacactgaattggtatttctttcattgaataaacatttatctagtgcctcctaagtgccagacaacacaaaacgtaaaataccattggcaaatccatagcaatcatacaaaagacgtgatatttgataaatataactcatacaatgaagaaaaaaaagaacaagaatttatacacagcaatttgacctccgtttgcaacacaacaatataaagtgtaattttctccaatctaaatttgctttgaaaatatggaacaccagctggaagggagctcagatggcttctgcagtggggttggaaatatccttctgagcatgtccagaacaactggttaaaaataattaaatcacttgcaccatctgtgaatcattctgattcttcaatgattacttaagactctcattgtatggaacatattctgagaacagatgaataaaatctattcaagtgtatattgttttccactttgattttcacaaaataaaaggattataatattttcaagttggtaagttatctgataattctcctgccctcctttatgatccagttgcttttgaaataattaaggtttgtttaaaatttagttttatgaataatacaaattcacatagccttgatgttataacataattttgcttaaaaacattctatcatttttaccctttatttaatcttttgagtatagtttagcacccatttagtaacagccaagagaactaaatggaagtccgaattgattgcattctcaaatttagcaccatatgctataatcatgagcagtttttaaaattcctaaatagctattttaacgcatgtaaaacagaggaaagctatatttagtggtgactaatccatggatgaaagatgcatggattaaatataatccaagtgcccatatctgtacaaacttaagatgttcagataatttggaggcattgttaactgtttttctggatatcagtgcatgggcacttctcgccagaataaattaactggggaaagttccagaaggtccataattttccataataattagtgctttcttagttaatagactatctgggtgatgaaaaataaatgaattacctaacaaatacagttatctataacatataactccatctgtgacccgtataaagctcaaaatgtgttaactggttagtatctagacaatcataaacacacatgaaacatgaataatatcggtcactatattttcatttcttgcttcgtagatacactcgagtatttcatatgtggaaaattaagagatctagtcctcttcatatattggcctccctaatgggaaagggtctctttaatctgctacaaagccctcctcttctttaaacttgccaagatgtcttctacctcaggtcattgcaattatgtttcctttgacttgggcctctatttctggatatttccttgctggtctcccgtcacattgcaggatgcagagtgaacattatctccacaggtggcctgccttcgacaacctattttatgtcgttcgccacatccattctatccttaccatcatgctctagaacatcagctagacgtttcccttctaatatttactgcaatctgcaaatgttacctttgcatgtttacttgtttataatttgtctgctatcattagaatgtaggcttgatgaagtcaggagcctattctatcttgttagtcactgtttccccaagacatagagtctatcacagagcaggtatttaatgaaagtatgtggaatgaatgattgaatgaatgaatgtataacatcttcctgtggaaatccctgcagtttcagagttggttgttctgtatttttatgtcagtggtatcctaatgccagtctgccatggtccagaagttttcaatggtccataaggaaaagaaaaaaaagagcaattttttatttagcttttcataaagcaaagttttttaatgcaagaattgtcctttctttcaaaattatgggtttcaacagttttggaggtattaaaatggcctttctttttctttcttctcattttgttacaatgtcctttactagaaaaagtaaagggcagaacttttgtgatgttccctaatagttttttttttttgtaatgttgttattgacctatgaaatacaatgtccgtaaaccaccaacttagataaatttatttacatgaaggaataccattcctgctaagtttctatattggttgcttgaagtttcagaatgaggaagagaaagcatgaaaaccatcacctcctatatgtatggcctgttcggcaagcagtactggccccataacagttatccactggaataacattcttgaatttattttgtcacatgtgaggagcaaaaacaagacaaaatacacaaaaaagagtagaattagggtatcacgacatttgtctaacattgttcaacgttaacacttacaaataataaaggtaccaaaatggtattttcttgtgtataaatattttcatcctctggatttgaatctgtttttgtttgttttggtgatataaagaactcataatagtatcatttcctgatgatatttggaatccaaaaattaattcaaaacagaagtattacattttctgtccttttcataattgtaaacaatgcatcaagatcaaaaacttaacaaaatgcgttaatgttattatgcatgcttttttcacattctttatttcccagtgatcataatgactaataattaacataattatttgtgattgacaaaagactctaacgttcatcattttagttaattattatttaagaaataattggtctggatataatataagccaattaaatttgtattctgaaaagttttgagaagtgaaaaaaaatttattttttatttggtaaaatactttatttctgttgtagctgcttttacaaggagattgtggggaggaacagtcatatccaagttctcagttaattaccttttcaaaatatatgatctaaaatggagtgaaaattgattgtgtcaatatgagtttttagagttaaaacttgtaaattttctggacagaatagaacaattttatattggaatccttgccataggataatacaatgactattatttcctggaacattgacagagaacaagctattttaggagaaactatctggattgtaaagtagagcacattaagcctaaggtgtcattaaattcacaaaacttttaaaaaagaattgagcgtaatctttggtaagagaaaaatggttttcttcagtgactattaccatattttgcaaagttataacctggcaaaatatattattttgggaaaataatattaaatataaccatttctatacacacagtggcactttatttattcagaggtcagatggatatcattttaatttacctgcaacacagccaagagtcaggaatggagtagaacaaaaggcctctcgattcccaaaattgattttttaaggttcatgaaatccaaagcttacttatatttcattatgaaatgaatttccaaatccttttttggagattttttaaaaattttgctttgattaaagaggtaattctaataaacttaattatctctttttttttttgtgcccctagtagctttgaagtcaaaatgggacagaaggaataaatgactgaaacaggagataatagctgcagcctcgagtaaggtgaaaaagaacctatatatatggactcatagtttggggaaataatttagcacagggcaacacagatgagagagggagggatggaggaagggagacagagagagagaacagataattagtgtttatttcattttatacttatggataatttaattatttcaatagtttattcatatagttaggtaaatactttttttttttttttgagacagattctcaccctgtcacccaggctggagtgcagtggcatgatctcggctcactgcaccctctgtctcccaggttcaagtgattctcctgcctcaacctccagagttgctgggattacaggcaaccgccatcacgcctggctaatttttttatttttttagtacagacagggtttcaccatgttgtccaggcttgtcttgaactcctgacctcaaatgatctgcctgcctcggcctcccaaagtgctgggattactggtgtgagccatggcgcccagcccaaggatctttaatatcttacctatgtgcaaaagtgtttaatacataatgccatatggcatattagcttcctaaatcacataccactgccaccagctaacttatatctctatatttacatctgaggctgcataggcacacataaatgtattcatatatgttacacatatgcttatttatgtagctatgctatatgttatttgctatttacatctattaagttacttagcaaaatatgtcctttggctttgaaaaaaatgcctgctgaactcatcaagattatgatttttgtaggttattctccatcttttagtcgagttcctaaagttgtgtttttttaactgcctgctttttattgcaggtatatgaaattgttgtgcatatttcaaagaagaatagaatgcagggtaactctcaaacttgttatttggaattaggtcagataattttgtaaatactgttatcagtatatcacaatgtcattagtgtcccttcaagttaagggcatggaaataaagatggtctaatgtgccaggccaaagaggaaaacttttcagcttagcaaagtgacttcaaatacatggggagaattgaagcagtcatttcaaatgcaaacaaaaagttgtatttttatggattacaatatccttagctaaatgtttactttggcttgggtatttttctcattagtgatacttatttaattagttgcttataaattgaacctgggaagtgtagtttgcagtgagccgagatcaagccactgcactccagcctgggcaacagagcgagactccgtctcaaaaaaaaaaaaaaaaaaaattgagtacttaagatcaattaaaatatatcgagtattggatgctgtcacataagagtgctattagccattggctgttaaatttcctcatctccaggaatctcaggcacctaaaaataattctctttacttcatgggcaacagcagccactagtctttgccacgactcttctgtcaattgggtatgcagtgaggggcaccaatatggttttaggtgatgatgtgaaattgtttcaaaatgctttcattctcccttctgaattttgtcttagtctatgcttccataatattgggagccaattagtagtacatgccttcctgcagcttgaatagaagtgaagtctattatgaacaataaagtcaattagagggggccatgcctactgataaatatgttatgtaaagactcaatttaccttgaaatctgtatctatttgcatctactctttagtgctagttcagagctctgtgcgattattttaaatgtattgcagtattactttaatcaattaatacaaaggtagattaaggaaactttactactcttcatttcttcattctgctgattcctccctcactgaagcaaaaaaaaagtctacaatttagtctttaaaaagtctatagtttagtcttagatatctctttgtactatattccatatactgttcattcttaccaatgaatagtatatatagatatattttacttttttaaaaaatactgctttattctgtgtattattttaaatataacagtcaattagaaacatgttcccaggtaatgtatatagatcttatacattctttgtgaaagtcttagatgatgaatcaaaatgtattctattattcttctacatttctggattattatattttgattagaaaaggtggcctatcaaatctttctttttgatgcttttaaaagtttcctctctatgtaatttttgatgtcccaagtaaataggagaatatgctttttccagtgtgcacaaaatacggattaaatttagcttgtcggttttaaaccacctctattcttgttttttatttgtattttttgtctattttaatctaacaaattacagaagagttgtatgtaaggtaccaactacagctatgattttatcatgttctccttttatttctagtaatttttaccttatgtagaatgcacccaattgtttggggcatagcaattaatgactactgtgctttgggaagaagtgtgatttttgtcattacaatggttctctgagacccatttagtgcttttcggtcttgaactatacttcatttgatgctattattttgactttcactttttaaaaaatggttttctaaatcaccattaacgcagcattgtgaccttgtatttttatgtttcttgtgactttcactttttaaaaaatggttttctaaatcaccattaacgcagcattgtgaccttgtatttttatgtttcttgtaaacagcctatagatggagtgtgcattttaaactagataattttgtctttttaacttatgcaaatatttttacatctttatagggtacatgtaatattttgctacatgcatagaatgtataatgattaagtcaggatagttagggtatccatcatctcaagtatttatcatttatatgtgttggaaatagttcaactcctctcttctaggtattttgagagatacaatatattgttgattatagtcaccctactcttctttcaaacattagcacttactctttctatgcaactgtatgtccgtacccagtaaccaatctctcttcacccattccgcccacctacactcttcccagcctctggtatctataaaaaaaaatcacatattcttaccaatacgtgcttgatcttatgaagatataaaaatgatagatagttcatctttagatgagacattttaaccaacttcatttttacaataactcttataactgtgtctgttttaattccttgtcatattgatggtcattattttatcattttatttactcttatcccttgtctataattttataattcatcatcttcttcactgcactctactgcatctcttcccgcacttataggttatttataagttatactttgtactatcattttactagtgctgtttcccattttaaacaacaattttatgcctatatttctgtagtgttgcgccaaaattaaataagaacaatgccctcatcaccaagatgatttacttagtcaactcctcattattttcaatcaaaggcaaaatcctttaaaaagaaataatttataattttatttcctggctactattgttttcacttgtagtatcacatactagttcaagatgtcatgttattacttaaattacactatcacttcataaaatttgaccacaaacgacacaaggtgtatttcctgtcactgtttttttgtaccgtttatttctcattgttttgaaatctttattacacagtcatccttcagtgtctgtggggcactggtttcagcattttgatatcaaaattcaagaatactcaaattatttatataaaatggcatagtgtttgcatgtaactatggacaccctcctgaacacttcatatcatctctagattatttatagtacccaatacaatgtaaatgctatgtaaatagttgttatgcagtattgtttagggaataatggcaataaaaatgtctgtacatgttcagtgcagacacagccatccatgtatttttgcaaatgtgttcgatcgatgactggttaaatccacaaatgtggaacccatggatacagagggccaactgtacttcagttttaatttggttggaacacatgagaaatgtcctcgtaaaaacataaaggatgtaaactttgtaaaccttgcattttcgaaatgatctttgctttgcagtcatcatgatggatttattggatagtaacattctttaatatctctcctctttttttagtagtctctgtaggttatgaacaattgtcttccagtttccattgttttcttgtttcaactatcttcaagctactattgtttccagtgtaaagtctgattctagtccaagtatcatttatttgtatttaaccttttttctttctctcaaactctaaagttgctgtctgtcccatctattgaagtacagaaatttcattaagatataattttaaatgtttctaaatgtgtccctgtttattattttattttattttattttgtttttatttttgagacagggtcttgctattgcccaagctggagtgccgcgatgcaatcatagctcactgcagccaccaactcctaggctcaggagatcctattgcctcagcctctttagtggctgggactacaggccatcagtaccatgactggctaatttttaaaacatttgtttgtagagatgatgtgtcattatgttgcccaggctggtcttgaactcctggaatcaagtaatcttctcacctcagcctcctaaagtgctgggatttcagttgtgacccaccacttatttaattcttttttgcacttgggtaacgttttaaataaccaattaatattaataacttctttagctctggaaaattttctattatgattgttttaattattacaaatcttccatctcttcttttttctcattctggtacttatcattgcttaataggtatcttagatctgttctctaagtctcttattttttcactattaatgtcagtttatttctatttgtctttaaattgtgatatacttcttctggttgactgtaaagaacccatattttatttttagccatgatcattctcttttctaagttgtctattgttatttaaaaactaggtaacaggctttctgtgctctaatgttaaccttttaatgtttctaattttatttttattaaatgtaccttccgtatcttctagtatactacttgtatggactctcagctttgtctttctctccagccccttgtgtcttctgaaaaagcctttgctttattttctctcatgcctaagtcaaagaatgtaaaatgtcttggcgcaaatgcagttaaggttttgatattttgatgcatagtgattgattgagaagcaacatggatactggaagttttgttgttgttgttgttgttttgatctgatgaataattatttaacaagctgaaacctattcacaaaatttacatatgggaaaacatctctgatctcatggacaaggggtggaagtaaggctgtcctcaaccatgtagtacagccactctccagtaatgcctgcatgaaacaaactagcaggtactgacccccttcttaagtcaaacagatctccttaaatcaatggtctccaacagatcattccacatatatacttgaaaaccatcagatccatcatttctgtctcagatcgtgccaagatacacataactttgaaatatcaccagttcatcatcattctctcttcacctgcaatttttttttccataatttgaggtcctgatacatatattcttctaaattgtagcagttagttgtgattatcttgacgttgcatggactcagttcaaagtgaaacagaaaacatatctacgatgtgatttacccattctcaacatttctattttgtgtgtctgtatttgcacagacacgtacatacatacatgtgcatatatataattaataagctttgaccatataaataatgcaaattatgtataattcacaataataggtttttaaattaattatcttcagagttgagtgagattacttacagatttaggctgtgtctacctgaaaacaaaatacagtgtattagcaattcagtaaaatcaattggatatagaataataacaaattagttgagttttcaccttgtgacattttagtttggatttagtagcctgtctaaattacctttgtgaaaaaactaggctacaagtattttctgatagatataataccagcattagaattattcatataatcttagttttcacattatttaaaatagaacacattgttatattttaataagcaatttgaaaaagaaacaaatctttctttcttgtatgattgccattataaaagaatattaattgagtgctcattaggtaactttaaccacattaagtactagacagccctttggacagagactgagtagaataaaaaacgattacagaacatactttggtattaaccttttctataaataaaatgtattgtcattctctagattagcactgtcctatagaactttctgagatgatggcaatgttctatatctacactgtccaataaagtagctattgaggctactgagaacttaaaacatggctagtaaaaacagatgtactaagtttttaattgtatttgcttttaaataatttagatttacatttctttcgtcaagtgtagctaatgactaccatacgggatagtgtaattatatgcatctttactatcactcgcatttctaatgaagagaatacttccttgaaaaacataattatgacacatgcatatttagacatagatactgagttgccgcattaatctagagatagtgtccacattttctgaggggtgtgacaaatgtaatatagaaataaaagtgtgagtttattctgaaaaatctactcaagttgacagatccacaaggcaacagaagttaaaagcgatataggagggtgaaatataactgcagtatttaaggtctttccatacttattttttcttgtgttacttttattttcacactgaattaagtataagtatgtgtgtgaggtggagggagggttcgatttgcttgtcaacatacaaaaagattgctatagcaagtattcccaagctgaaattttggaatagcttaaaataaaaaatatatactagatatgtaaacgaaaacttttatgagaagagtttgggaagagttatcaaaggttaaaatgattttttgaatacaagtcttctcatacccttcaatttgctaatagacattatgatacccatgaagaagctaaaatcagtatatcttaatatcgtctatatgtcattacctcaaataattgcttatgtttgtattcaagtataatgagtcagattagtaactaaaagacaatttaaggacctaagcacgcatgtacaatagcatgtagctaatgtgctatgaattgaagaaatgcgacatagtgaaatcagatataccttttaaatctatgacaataaagattgcattataaaatgaagaaaatattcctgtttgaattctgaatattcctaaatataaattataaatgtaaatcccagcaattgtaaccacatatctatcttataattatcctgttaagttgatacttgttttttcattaatttatccaacaaatatttttgataacatactgtatgctaggtactaggcatgagtctttgctgcatttattttttgctgccttataagttggctagggtgtataaccttatctattaatttataggttattttttggagatggttttacaaagcaggccatgattgttggtgcttatatattgctgcttatgtgttgatacttatcttggtggcaaccaaagcccttttctttctcttctctcacaggccatacttagtgactaaaattttatcaagttactaatttatgttaattctttgaaaatctgtataaaaatgcaaatgttgtcctttgaaacgaaagactttaaaccactataagccattaacacattttccagattcagtttatcagcttaatttgatagtaattgagcttggccctgaggaattaggtaaatttcatggtgtagaaagtcagaatccacatgaggcaggtcaatgagcaggtctgtccagaccttttacataggacactatttatacctggccttctagaagcagggtgtatttaaagactggcaaatccagcatcatctgcatatctttttcgctgacagcctgccctgctttaaaaattaattctaactttagaaaataaataatatgggcataaaggatgattttctttcatattttaccttgactattttgtgtatgttagtgagttttattctttttaaacaaagggggtaaattgttcattgattctgaataattattctgagatggacaggccctttttttggttacatagcttcacataagcaattttttagatgatgcaataggaagggggaaatcacataagagcaaacactctctcattgctattttttctatgcacggtcataaccaatatgcttagactcattagattgattattcaacatctttctacccagtgacttgactaaaacagacaaaacgaagtactgtcagaatgctgttattgtcatgccattatatgtatccaaaacagtgacaacgcagattaaaaccatacccgtctcacctgcatcatgttgttttgtttttatgctttattgtttggggttttttaatcaccctggaccaatacaatatttttgcctaatttgtttgtgatttgcatttttatgcttacaatgcctattataattgtccaggagaaataaataaaaaatctctcaactttgtttattactgtaatgattcctagaaggaaacttgtctttctctgaagacttgtggggctaagagacagagctacttgtctaagacttaagtctttcccattgccttttcatttatgacccatcagaacctacttaaagcctgcagtcctattttggatttacatatcattgtgttattacttttaaataatccataatatttaagaatgtccctttgaggaaagataatcagatacaaactgacatactttcatattatggctcatagattttcatattatagctcacactaaatcattaataaatcttactttgaggatttgcttattttcatcttcattaacaccaacgcagttaaaaaaaaaaaggctccatcactattttactgtttttggtcaagataatagtctatttttgttacacttttgatgcattgatatatttttcatgtgccatatttatatgagatatatagttattttgtggcatatgtcataatcatatgtcatatagcacatttttcttcttgagtttctttgacctcataactcataaatgggccagtaacctcaatgcatttaaaggagaaagaagtcttttaaatcatggaggaaaacattttgtttaaaaacctagacataatgcaccatttgtttcaaaacaggattgcttttatcctttgcagttatggcccttcaagaaacaaattttatgtaatgaaaagaatgtgataacttaagtttcagatgaatgaaaatgtattcaaaactttgtgagtgatacctgtgcctatttacacagctcagaatcttaaaactgttttgactttaagtttagatcatacaaatcataattgtgttctataatagtcattaagcattgatcgaacttttcatttttaaataaaaataggcattttatggtttctttcacatatctttttgtttctagaaaatgaggctagtatattctttggggtatatatggttaaaaatgaaaataaacacaaagaaataaaatgaattaatcagattatagcatttccttgctaatgatgcatgagtatctataatgatataaggtggtaaagaacattaacaaaagcaagttgattttcaaaaggttagacgggatttgtacacatcagaactcagaaggataaaattattcaaggcagagttaatgaaattcaaatgaaaaggattaatctgaatgagtacctggattttgcataaagaagagaaaatgaacatgatatttctaattacactgatttttaaataactgtctgaaatttttattaaaccaaactgaaagtcattcaatggatgtagttttctcattatagattcgcatgactgtgtcaataggaatgctatacttttaaggaatagatagcaaactagatctccaaatgtctggttctcttttgattcaatttctggtagtttcttgtatatgaaaattacaaaaaagtctatatattaaacattattgtatatatcagattgctataataaatgagaatattcaaacttaataacacggaattttctagaaaatgagttcacagtttcccagtggtgtcaaaaagttattttggaatatttctatttctcaagaaagttcacaggatcaacccttagttttctctagtcagctgatctgtaccacttagtgtctgttatctgtgatgactggacactacgtatcaagatagtaaatctttcaatagatccgtcttcattaaatatatttaaagtataacattaaccttttagactttataacgtatagctgaactgttgcccataggtaattgtaatgagaagcatcttagaaattacaggtattctaatttatctttataatggaaagaaaaatttttgaaagattacttaattatcagtagttgaggatagaaatgatttttctcattcagatttttctaaagtaataaactatacctttttattgattatgttcaaccataagaattttaatatttctaagtgttctagaaaatgtgttcatgccatggctgagcatgtagggattatttccatgtattgacactggttgctctatggcttatttgtgacaatcttgaaaataatcacaatatgcatattattagagcattctcaacctgcagttcaatggctaatatttcttttaagagtatttcgatcaggttaataagagcttcttcattatttaaaagtttgtaaaaaatgatttctagaaccagatacagaattacaattatttgtcacttaggtatctaaaattttcttaaaaattgaactcttgtacagagagtaaaaggatgattaccagaaaaattggcaatttaaatagatgccacataacactcttctaaaagagattttctttgaaagataggtgaaaatggtttttagtttaatgttctgaagaatatttgttaaatcggtatataataatctatggtagacacatggggtcaggtggagagaagcttaacagatgagaagccagggtatggtgtgctgcctacattctttaagccctggtttaggactatgattaacactggatcttatttgctgagacacagaattctggtctgagagcacgaattattattttctaagtgaatctaatttttattttatccagtgtcactgaatgattttttctttttttttttaattatacttaagttctgggatacatgtacagaacgtgcaggtttgttgcataggtatacatgttccgtggtggtttgctgcacccatcaacctgtcatctacattaggtatttctcctaatgctatccctccccttgccccccacccgccaacaggcccctgcggccatatgttttcattgttcaactcccattatcagtgagaacatgcagtgtttggttttctgttcctgtgttagtttgctgagaatgacggtttctagtttcatccatgttcctgcaaaggacacgaactcattcttttttatggctgcatagtgtcccatggtgtatatgtgtcaattttctttatccagtctatcactggtgggcatttgggttggttgcaattctttgctattgtgaacagtgctgcaataaacatacgtgtgcatgtgtctttatagtaggatgatttataatcctttgggtatatatccagtaatgggattgctgggtcaaatggtatttctggttctagatccttgaggaatctgcacactgtcttccacaatggtggaactaatttacactcccaccaacagtgtaaaagagttcctatttctccacatcttctccagcatcagttgtttcctgactttttaatgatcgccattctaactggtgtgagatgctatctcgttgtggttttgacttgcatttctctaatgaccagtgatgatgaggtttttttcttatgtttgttggccgcgtaaatgtcttcttttgcgaagtgtctgttcatatcctttgcccactttctgatggggtcttttttttcttgtaaatttgtttaagttccttatagattctggataatagccctttgtcagatggatagattgcaaaagttttctctcattctgtaggttgcctgttgactctcatgatagggtcttttgctgtgctcttcagtttaattagatcccatttgtcaattttggcttttgttgctgttgcttttggtgttttagtcatgaagtctttgcccatgcctgtatcctgaatggtattgcctaggttttcttctagagtttttatggtttcaggtcttaggtttaagtctttaatccatcatgagttaatttttgtataaggtgtaagaaaggggtctagtttccgttttctgcatatggccagccagttttcccgacaccatttattaaatagggaatcttttccacattgcttgtttttgtcaggtttgtcaaagatcagatggttgtagatgtgtggtgatatttctgaggcctctgttctgttccgttggtctatatatctgttttgctatcagtataatctgttttggttactgtagcattatagtatagtttgaagtcaggtagcgtgatgcctccagctttgttattcttgcttaggattttcttggctatatgggcccttttttggttccatatgaaatgtaaagtagtttgttctaattctgtgaagaaagtcaatggtagcttgatgggagtagcattgaatctataaattactttgggcgctatggccattttcatgttattgattcttcctttccataagcatggaatgtttttccatttgtttgggtcctctcttatttccttgagcagtggtttgtagttctccttgaagaggcccttcacatcccttgcaagttgtattcctaggtattttattctctttgtagcaatttttaatgggagttctctcattatttggctctctgtctgttattggtttataggaatgcttgtgatttttgcacgttgattttgtatcctgagactttgctgaagttgcttatcagcttaaagagtttttgggctgagacgatggggttttctaaatatacaatcatgtcatctgcaaacagagataatttgacttcctctcttcctatttgaatatctttctttctttctcttgcctgattgccctggccaggacttccaatactatgttgaataggagtggtgagagagggcatccttgtcttgtgccagttttcaaagggaatgcttctagcttttgcccattcagtatgatactggctgtgggtttgtcataaatagctcttaatattttgagatttgtcccatcaataactagtttattgagtgtttttaacatgaaagggtgttgaatttatccaagaccttttctgcatctattgagataatcatgtggtttttttggtcattggttctgtttatgtgatgggttacatttattgatttgcgtatgttgaaccagctttgcatcccagggatgaagcctacttgattgtgatggatatgctttttaatgtgctactggatttggtttgccagtattttattgaggattttcttttttgttgtgtctttgccaggttttggtatcaggatgctgctggcctcataaaaagagttagggaagaatttattttcttttgtattgcttggaatagttttagagggaatggtaccagctcctctttgtatctctggtagaattcagctgtgaatccgtctggtcctgggcttttttttttttttttttttttggttcgtaggctattactgcctcaatttcagaacttgttattggtctattcagggattcaacttcttcctggtttagtcttgggagggtgtatgtgtccaggaatttatccattttttctagattttctagtttatttgcgtagaggtgttgatagtattctctgatggtagtttgtatttctgtgggatcggtggtgatatcccctttatcattttttattgtgcctctttgattcttttctcttttcttctttattagtctggctagtggtctatctattttgttaatcttttcaaaagaccagctcctggattcattggcaaatctcatttttatttaacgttcctttctgcaaataccaaaatagtcaaaatttgggtttgaaatttcatttaaggaagttaaatacaagttagcagacaaaagtgagtatattttgagtgtctttttcttcattatatttgaccatacagctaagtttcttgctggctataatccacaattactatatttattaagcaccaatatgaatttaagatagctgagagcatctcaaatgaaagtaatgaagactgagaaaactacatatcaaagaagaatcagaaaatagataaaaacatcttagaattatttttcttttaagaaaaagtgatgaggacatgcatcaaaacttttctgaattcccactgcttttgttaaggccacccagatttttttctaaatattttcaagatatgtccaattctgaaacaactcccttgattaaacaacaaaacaaattaataaataaatgaaaaactacaacttgtcttctacttactctgttcctgataacaaaaacctttgttttccaaaaacttacaggtgtaaaatgtatcattaaaggcagatttaattgcaccattaaataagtattataagaaatacgcttgctttagatgatgtgaagctatctttactgcaggggttatagcaactaacgtgaataagaaagacgagcttattaacttgtaaattttattaagaacaacataatggtcaccaaccaatgtaatgcgtgcaaaacacaagcttgtgttacttgtgctattgattctactgtttaatgtgtcagtgaaaatttcacattcaaatagcctgctgagttatttttcttttaaatgtgtaaaatgcttatgatgaaatagtgaaattaagaatttcttaagaaatctgttaaattctgaattttatttatcaaactctggctcaagtttctaatatccttttaaatgtaaatgagaaatatatatacattattccattgaacatgaaggaatgtgtgccatggatttggcccagatatacacaataaaacaaatgttgtaaaaggtataattatttaatagctaatttgtgcaattctgtgaatttgctatatcacaagtagatgagatatctaaattagaattacttcattttttatatcatgtaagaattgagtatgaaaatcctaggtcagagaaattaaaaacaaaacataaagtgaccagcttgtaaattttactcctctttgtgtggggttcagtctagtatccccaaagtccaatgtattacattactgcaaaaataagtatggtgttgtcataaaaggctgtgcagtaataaatggctacgttagcatgcttatcgtttgtacttccccagagaccctaccactgaaaccctcaggtgacctcatcaacaggcaggtggcagttgatcaattctagacaaagttattgggagaataatttcaattacaagaattttgctgcctatagtgtagacagaagagagcacaggtcatccatctttctgaatttgcctgccaagtagtatttattttttgctcttataaagaatagggaaagatgtattactgggaaactccaaaaggactctggagctggaaattctcatcatgtctagcacttggatcccagtcagaaaagtgtaggtgcaagagaagaggctagtgctcccttatatatcaggacattctggagttctttttaaaatataaattccgcagtcagttctgctcatatagcagcttcattagcagcttaacttagcaagagactagcaacaaaaacaggagctaatgtctagaatttggaggagaagagggcttaatacaaagttacataccagcctaactacttcgtatctgttgtatctcagtgaactttcctatagatacaggaaagttgcctgtgttaggaataaaacagatatgagtccccctcacccaatcccatatctagatttccaggaaaattagaattttaaatgccagttgcaaattagaattagaaatttaaatgccggttgcaaaaatcgtctttttcttaggataaaactactctccttatgacctcatggtctttcgtcttatatttatggtgctaatatgtgtgtgtcacttattatgaaatgcttttaacactttctggaaaaagtaggtatataattaataaatcaccgttttactagacttaccatcgtgaggttttgaatccattttcagcccagtttgtagattcaattgtcagctgtagaatgagacctatataaacttaatggaggaggtttcactgttaggaagctaaaaaaaattgttcttttgtatatctataccagcacactgtccgtgaagaaacgatgatggtgatgactgaagacatgcctttggaaatttcttatgtgccttctacttatttgactgaaatcactcatgtctcacaagccctattagaagtggaacaacttctcaatgctcctgacctctgtgctaaggactttgaagatctctttaagcaagaggagtctctgaaggtaaaaccaaagcactttcattcgtattttacaaggtgatcatactgatcattcatagtgccagaacaattgacttaaattgtatgcatcatgatggcattttgactttcacatggaattcttaaaaatacttgatagtgtggttggcttcagaaatctagggtagaaagacataagttagaaaatgtattttacaatatttagctttgagagacatcctaaaatgaagaaatgcacaaaaatgatcatttttacatgcagtagggacagaaaggaaccaccagtaaataaactttgatggaagaacagtttattcctagttaatggatgacttctgtttcattttccaaaaagggaaattagatttttcatttatatgtaatgtatattgtttttgttttatattttttatgtatacatattcaatttcaaattaatgtcaatacctgtgctataacatatggaataaaattgaatagaaatcaataaaatattttctttataactgccagttaaaggctaccaacaaaatccagctgttttcaaaccaccaacagcaagttactaaattctcaagtaaggcaaataatgatgatgaaataggctatgaatttcagaaggcagtgtctgaagataaatgaatgtaggatcaagaaaatgcacataataatgtgtctccagataattttcatgatcgtacattttacactcaaaatgaaatattatagtatacccagagcttggtattttcaaatgcaaacagtatgtgattataggcaaaagatgggtttgctatcagcagcacatattagctaaagtattttatactcaaatggtttcctggaagctcattctatatcacacatttgcctgtatgaatatacaaatggataaagctatttgtttgttttggaaatcggtgttgcagtatcttcagtgacttgactttaatatcttaacattatatcaaataagctataaaattacacagtaaaataagagcttcacagatctctggaactattccatccatgtcagtgtggcactgtttcttattctgtttgaagtaaaagtcaaatcacttattggtacaatgaagaaaagaaacctaatcagttaataaaataaagctgacatgccagaattcctgtcattatttctattaactaagttctcatggcagcatagtttgtaagtgcatcattgtcattcaataagtaaattattgccaatgagctaatatccattccttcccaggttcatggacatttggttcaggagagtagtgaccctgatcttattaagttgcccattgaataactctgtctccatacctcttagcctggcatactcagaatgttagacccttggctacactcacagtgaatcatttgttcatcctgatctatttaatattattatagctgatgtcaatcgtaatagtattgattactgcggtttataatatggtattattgtagatttaatttagctaaatggttgaatccccataagatacagttgtgggcatgattccttctgtctcccaacaaatctccagcaggtgaatgggcttcctaccttcattgacttttttgaagggggatagttttgagctcagtcttttcagtgaatatgtatttcctgttaaaggcattcatcattgtcattatccagtagtaaaaatggaaaagcagtgcataaattgtacagctgctggttgggaaggtttgaaattgtggttgattttattcctgacagatatgcatgaatcaaattacagaactatagtaagtattgctgtgctttaacatacatcttttttgaaagtgcagtacaacacaaataatatgtaatatgttaaaagaattactttctaaacaaaatacaactaaaatagcacgtatggtttcaatagatgtattgaattggaaagctacctaatcatgttgacagagactatgcagataaacacaaacatatatatatacgtatatatatatacatatgtggaaatctgcatttaatagcaaaaacactagctaaggcagagctagagaagaatgagaaacatacacataagtaatattttctttcttacttcagagccaatattaacagttaattgattgtgattgcttatatgtacaaagttaataatactcataacagacaagagtacataattttagaagaattgcaattttttggaagtttagagcaatattaacttgcatttcatttttaagaaaaaatcattttcatgataaaattttccaaaatataattactgtgttaaaccgtcaaatcctgccttaaagtatctcatatgaaagcatgaacacagaatttcttagcatcgtaagttttaaattaccaaaaggttttctctggagagagttaaatatttgaaagcttatcctaaaagcagaaatgatccacttaaaagacttaactgaaaggatttatcatcatgtgtccatatgcctaattttactgaaagcatcagttttattggaggatgaaacactcttgggatgtcacccatatcatttcctgactcagcatgccttgtactctgactggtagctgccagatccaagtgtctctgactgtttgccttagggctctctctagtaatcaaagctcatgagtgtcaggtagttaaagttctgcatcccccgtgttccccagcaaacctcaaccaataacaaataacttttggtggataaataccactactcactcattcttcagttagggtaactctgaagcatgatttatgctctgacccaaaattctgttccaggattaagaccccatcgcacacagtaaaaacctgcctcataggatacatttcacttgctccctgtcctaccttacacacactttactagcacctccttggatcattcccaaagacatcccttgtcttcgaatctgcttataggggaactctatctaggacatttttgaaataaataatgacatatttactgtgtagttagcatttacgtagagaaattcttagaaatagttcatgcctttggagtggaattcttcaagtgattctgctgctccctcattcagggaatccttagctgttcaattaggccttggtatcaataaatgtgaatttttaggacaaaaataagaacatagcttataataagaatgacaactatgctttaccttttgcaataatgagaatcaatttacagctaatattattctttatggtagagcagaatgtcttcacctgaagaacatgaacaagacaaggatatctgcccacatcccttcaatattccacattgcactggagtttcaaatcactgaaaggaggaggaaggaagggaggaagtaaggaagaaagagagtgagggaaggagggagggagaattgaagaaaagaaataaaataaggagagaaacaaggaggaaataaatggaaggaaagaaaaaatatcaggcacacatcatttcagttgtctcatcaaaaccaattatagtacagatgccttgtttggaatgaataaaatgtgctatactttgggtaaccaagagggtgatgaaaaacgtggccatatgaagaaagctcacgggtaggagacatggtggtcctaatgtagattttaaataggatcaagaaatagagacaacccttgttcaagttcgagaccacaagggaaagctggtagtgagcttataagccaaagatagtgtgaagccaggtcgttcaagtcctcttgagttcaggttttttgcattgctcttgagaaacaaaaaattgttaggacaagtaaacctaaggaatgtggattcgtatattccaaaaatagttattaagctcttagtatgtaccacacactattctaagtgcttataaaacagtgaaaaagactaacgaatctttgccctcattcagcttttattataacattgggagacagaatagaagcaagcaaacaaagaaaaatgataagtaaatattgcgtattactaggtgatacgtattttgggaaaaaaaaaaaaaccagaatctgttaaggggatataggaccactacaggggtagacgtaggtataattgaaagtggcggaattgccatttcaaatagggtagaaatgacctttgagcaaagattggaagaaggtaagggagtcagccatggagtctgtgtagaggaaatagagtagaggcccaaatgtgggactgagcttatcttaatcaagcaccaacaagaaggccaaagtggctgaagcaaaacaagccagtggaagggtagaaagagatgaggatatgggagttgtgagtgtccagattgtggagggcctttggggccattgtaaagaagattctaaatgagatgagagcaattgtaagtttctgagcagttgagtggcatgatctcaatcatgttttaaaaggatcacactggcttctgggttgagagtagaactgtaggggaccaataatagaatcaacaagagttgaaaaagagatgctggtggcttggacttggtcggtagtgagagaatgtcagattctggaaatattttgaaattagagatagcagatatatttctctggtcatacagaaacttaagcatgtgtctatgaaaacccattctcggccgacttggggctgagttagaactttggtctcgtaaaacctagcagaagatcccttgagagatgtatgatttcttctcatattttagtcttcgattcttcagtcttgccttgaagtagggacaaaagtactggcaacagagatttttaatacactggttaagatctttctcctctggaatctgtttcacagctcttaagcacaaatttaataatcccaattagttaaatgaaggcaaaattatgccatgagcaaagtgactgcttttctattctggtattaggagaattagataatagcaagaggcaccatatgtagaaatccaaacaaaatatctgaaggaaaataaaagaacgattgtttatatgcgtattgtaatacaggggcatattacattgtttatatgcatattgtaatacaggggtatttaataatattggaataagaggacattgcaattactctaaataatcatggatcatataaaatttcaaagcaaaatttgtttgcaaatgctttttgaattcgagttgaattttctaatagtttaatagttctaacagtttaatgcgtggaaaagatgatttttattaatacattgtgactttgtagaaactgatcttttgaactatacataaacatttgcaataatgtgatcagtggtttctcttagaaaaattgagtttttcaacacatttatttggttataaatataatttgtttcttcaacagcttatatgacttgggatttatttgattgatttgctatatataaatgtgtgtattttcaaatattaatcattaactgtagtttaaatcatgcttaaattatttccatagtacattatttttcatttgtattatatgaaaagatttgtactatagagaagagattatagatatttactgcctttcagtcatgcccagctcatatttatatgtgcttcggtacagttttcttttatattttatacaaatctctcttgtaggaaattatccattctttatccccaaccattattttatcaagcctagcagttgtcctaccttgactattatgctgcaatttactcccaactctgctaaaatgtactttaagaacgcactcctactccttccattctcccagcagcactgttttcataatccccatcgtgtaaagtgtagaaagcagaaacttccatattaaaacttacaaatcatgaggctggtagaaattttgaagttgcagttaagttgtggggaggttttccttttattcacaaacggttgaagctgtgcttcgaccagttataatgtcgttttttatgtgtgatatataattactgattcgttatttatgcaaagacaatgcatcatcctatgaagaatattttggtccaaatacgtagctgtgtttagaaagtgttttctcacatggggacaataaaccatgaagaaaaaattaaaaggtcaccttaccatagagccaccaaaaataactttttaactttttttggaagctccgtaaaacctagttaataagtactttaatgccttttgattgaacacagttcccaattcgatatgtcattaatgtagtgcctggtagctggatgggatgtgaagagtgtaagaattagatttatatagggtgttgcctttatctgtcagataaagacaaattccagagagtgaaaatgaactggagtttgagtctttggttctcttatttctctttttccattttaagatagatctactccccaacggccgctgtcacaacagttactaatgggtttttctaatccttttttcttagaaatgaaagttatgtgctcctctgttaaccaagttacaaagtgtctcaaggcatttctgatacctaaaactgcttaaagctattattttcaccttcccaaaatatgacgacaatagtgcctagagttttataagtctataaacactatacatgcatttaagtatatgtataacccatgtaactgcagtgctacatttttcaagaaggtgatacatacacacagccaccaggaagaaaaattagtatcttgtttgttgtttttttcctccaccactgtatctagaactcctagaacagcacctagcacttaaaggtactgaatgtacatctgttgaattagtgagtgatggtctgatacatgtaggtgtggactctgagatagaagaagacagggcagtgttagtaagcgctggtactaaaagagaaaaccaaatttacttctttttatattgtatcctaactcactgagttaaatcatctagacatgtgcattctacaaatctatatgcatataagcatgaagaaattgttctaggtttgtatatactgaatctaaaacaatcatttatgaaaatgtgtgacagggaacccacatataattaaaacattactaacatttttccacatcagtgagctttcattatgtggttatgataagcagtagagtagagagtttagcaaagtactgtattggaacctgaaaagcttagaaagatttaacctgattgttgatagttgtacccttgggcaagtaacataagatatttaggcctgttttttaacgttgaaattaaatcagtgataataactgcccctgcctactcaactgtactcttgtgaagatacagtgaaatcatgtacgactgtgtaggaaaattcctgttaaaatgtataattatataaatttcaagatttgtaaaatgcatattgcttcatcaaacatcccaaattctaagaaagttataaatttccacgtaaagtatcctaaaaacaaattacctttaagaatgtgttaaacattataaaattgcatatttatatcttaaaaaactgtaaataaaatgttaaccacataaaatatacgtaaagttatttccagatgtggcaaatattctaaagctaaaaaaactttaaaataagagaatacatacaagctaagccacgtttgcttttgacaaaatcttccttagaggatcttacaaacttttgatcatattcttctattgtacagaatgttccttgacttgtgatggggttatatccagataaacccattgtaagttgagaattttgtatgcggaaatgcattcaatacacttaacccaccaaatatcatggtttagcctagcttaccttaaacatgctctgaacacctatgttaacctacagttgcgcaaagtcatagaacacaagacctattttatagtaaagtgttgaatatctcattcaatttagtgaatactatactgaagtatggtttcgaatgaatgtatatcactttctcaccaccctaaagttgaaaaatcactaagtagaaacattataagacgggggccatgtgtatttccgaggctagttgttacttattcaggagtaatttttttattcttctatttatttaaggtataaaacaaataactcactttattgtatatttatcttgaggtgcagaaatgcaactctaaattattccaagattctgtgtaccataacttttaccaagaagaggatgctgttttctagcttggttttaattgttgttttattttgggctttagtttctttatgaaatgtgttgatttattttttccatttctagttcagtaacttaaaacccattgttctaattgtgagttcagaaccatgacaaaaattattgaaaaatattgaaactctaagcaaagaatgatttaatcagtagtgtttttttctcttttttgctttggagtcttgaaatttgcttttgttgtttattttttgttgtctttcctttgccatttaaaaaagttagtttgtatttattttctcctggttaaatttgtaaccatgaacatattaaaattataatgctattccattgaaccttatgaattgtcaagtctttcaaaaggtttaaatattggcaatatcttatagtttaatacaatgacttgtacccaagtctgcttatttctgaatattaatatatatcattaaacatcctgatggaaaaaaaacaagaactttctgttgtaaatcacgtatgattaacagacaccaattcccaaatttaatttgccaaaccacaggcaaaaattaaatagtgttatcagtaaggaaatctatggagcttccaaaaaggtaaacattgagtagagtgttagcttcctgctcccatatcatgccttttgtttatttcttttctttcttttttttttttttttagatgtatgcatttgggtacagaacaattgtatgaaagagcgattttgcttttctgtcccctgtgtaaaacaatatgatggaaagcacatttccccaacatcagaagtattagttatatataaaacgggcataatattaccaaatatgttttctgttttaccaaaatagtttactgtcatcaatattaatttttgcaggtttgattatattttatcatgtatggtagctacctatgaagttgcttaatcatttatactaaattttcatttatcaaaataataagatgctcatgattgcatatgtaaatagaattaaaaagtataacatgaattttaaaaaagcatattccattcattggtgatcatcagtttttgaggttttcttggattgttgtattgctttggaatttttcctccataaaacctacctggccctcctctgctgagtcacacaacactaaagcgtatcctgactctaagaaatttgggatcatagaatgccatatattttgaactaagagaaaagtacttacttctataaaaccccctttgccatgcatgtgagtcaatttttctatttggattttctgtaaaatgatttaggcgatgtgtacaacttaacacaaaatgtacgtatcataaaaggactggtaaaattgttttcaatttacttagtgctgatggactagaatcattttatctgagaaacacttggatcagtaaagtgcagggttttttttgttgttctttttgttcttgttgatgctctgtggcatctggagaaatgggcaggtgtaattctgaataaaggacttttttcttagatatctaatgtgctgtgaggaaaccataaggaaactcagccaggaaatgcatgtggacttctattccactgttcaacagctaatgtcttgtaaaagtaaagtagaataaacaaggaattacctgaatagctcacgtctgaccatacctgaatatctatctacaatggttgaacagagtaacaaatcttagaggttcaatgattgaattcaaattggattttcataagcaagttcaactcaactttttacttcaagtcaacagatatttattaatgctacaagtgctatgcttaacattctaaaagataagaaagaaatattaaggaataatccttgtactctggtagttgataacattattgaatatacatattatagttatacaaacaagttagagagtaataaagacattaaggacatcatccaagcaaaaatatataagacatgagtgtaactgaaatcatgaaaagaagaaagcagcacaaaaagcagaaactaggaggaattttatagaggaggaatccttagcttgaggtgtgaatataactggaatctggactaatcttgaatgtaatagctgacagttattatttttgtgccaggacacattctaaacacttagagtaacttgtatggtcatcataacagccctacaaggaaggctgtattattatacccatactcagatggagaaacggaggtcctgagcagttaagtgacttgctcaggtgagatcatttttaaatatcatagttgaagtcccactctggatgttcaagctccagagtttctgctcttaagcactacgctatacagtttcttgatgcagaaaatgttttcaaagttaaagatacaaagtcagtaagggtaaaaaaaaaaaaaattgtatcagaaggatgtgtctgaagaataacaaagagattaatccttcactttgttattcactttgattatcctttcaagtgtctctgctggcaaagcactaggaaatcaagttggataaaaactgtgaatccagttttttcttttttttcctggaaaaaaagatgggctaaaagatgggcttgaaagtgtccaaaaagctatatgtcatcatggatggattttggtcagggataatccttaaaatggcaggataaattggacacaaggaaaaataaagagataaaacaataagtaaggagatatttgtgttcagcatagctggaccgatttataaaccatacccttgattcagtagctgtaccaggactctcattattaaagttcactcaggagatgcccaacatcctagatcacccattttcctgtgttagtgcaaaatgtggactggatttcccgatacatatttctatctagttaaataaatactctgattggttaaggaaaggttttctggaaggtgtatataatcccaccatggcaacagaaccaagagtctctgactgtctaccaacctgtagacttgaattttttccctgtactttcttctagcttcttcgatttctgttatccccaaaacaccttgatgtagccttaagcagaatcaaccatcaaagggctaactccctcctcctgctgggtgccttctctgttgggccccagcagcagtgaatctatgctcccaacttgacatttttcttatcccctttcccacctcccctaaataaaattcctttgtgtcaaagtttgatttaagtgatagaaatggctaagattgtctacagggttgggtttggaagaaaagaggtctggaaagggaatatagcaaaacatcagtattttctgagcaagtttggaagagattaaaaattacccctagtgactctcaaatttatatctctagtcaagattcctctcctgaatcatgacatatatatatatgccttttatatattcacttagaagtataataaacatcttaaatttagcatgttaaaatcttacaccctaaccttatcctcctgcagttttctacactatagttaatggcaactccattattccacttgtctgtgccaaaattcttcatgttatccttaaggcctttctctaccaacacacatgtaattggccaccaaatcctaaggattctgcctttacaatgtatccggaattcaaccctgcctccactctgatccaaagcaccatcatctccagcatggatgattgcagttgtctattaacaagtttccccctcattgccttctcccctgtagactctactgtcaatatactagccagagatacctatttaaatggaaagtcagattatatccccctttctgcttctgttcaaaacccccaatgctccccatccccctcaaagtaaacagggaagtccttatgttcataagtaccttcatgggttacccaccccattctctgatatttctctggtagtcgctagctcatacactccagccataatcacttcctccatgttccttggccactcctccaggcacattccagtgtcagggcccttatacttgctttacctgtctggaatattattctcatgatttttctttcaatggttaatttctgcatttccttcagatctttacttaaaaactgccttcctggtaaggtcttccccgacccctcttacctaaaattctgacccccactttatccttcatttcttccttccctgctttagttttgctcctcagcacttaaccactatctaactgagtatatagtttagtcatttctctatttgtttactttattctcctgtagaaggtgagattccagagagcggggcttttgctttctggatcactagtatatacccaagatataatatatgactgtctcaggctgggcgcggtggctcacgcctgtaatcccagcactttgggaggccaaggcgggtgaccacagggtcaggagttcaataccagcctggccaacgtaatggaacccgatctctactaaaaatacaaaaaattagccgggcatggtggcgggcgcctgtaatcccagctactcgggaggctgaggcaggagaattgcttgaacctgggaggtggaggttgcagtgaacagagattgcgccactgcattccagcctgggtgacagagtgagactctgtctccaaaataaataaataaataataaataaataaataaataaataaataaataaataaaatatgactgtctcatggtaggttttttcaacaaatatttcttgagttaatgaatgaatacagcgatgtagctgtcagacacagagagagaaacctagaagatagtattactagttaaaactagtgtggctaggtctgtatgatgaaaactgtgcctaactgtactgaatcctgccaaggagggaaagatgaaatggggaagctattactaagtgagtgaataggaatttccttcaggaaataaatatggttaaaaatgtgaattataagtgcttccagctgtctgctaatgttagtccttcagagaaatgaaaactgagaaaccattagaaagcaattttatcacttcttttaaaaaataaagttcaatatatttcaaaccagaatatcatcgaaatactgaagtcattttcaggggaaaatgccctgaaacaacaatttcatattatcttatattttaacttatgcttttatacatttgaaattttatttcatttgaagacttttttctaattgaaatttttgactgagagaacactcacaacttctgatgtaaaattttattactgaggaaaaactgttaaacagaagacaaattagccaattaatgtttgtatatacatcccacagtggacatattatttaaaatcttggaaagagttgtagatttgtgaaggtatatgtgagcttatttctaggtatgaaataagggagcaaagacacttgtaaattatagacatccttatttagtaattggatgttgaagatgaagaaatggctgaattgaatgaccacagagacgggacagaggaagtgatgtttgtttgtttgtttaattgtttattgagacagagtttcactcttgttgcccaggctggagtgcggtggcacagtctcggctcactgcaacctccgcttcctggggtcaagtgattctcctaccttagcctcccaagtagctgggattacaggcgcccaccgccacacctggtgaatgtttgtatttttagtagagacagggtttcacatgttggtcaggctggtctcgaactcctgtcctaaagtgatccacctacctcggcctcccaaagtgctgggattacaggcgtgagccaccgcgcccggctgctattttaaataatagaactttggcacttttcacagtattcgggaagcaacgagctttgctataggtacaaaaatatatttaaaacttcagtaaattattttaagtttactttcatcaaaagtgattaacagtaagttcaatttgtcagatattactctcccctactctagttctcttcaggttctgcaatatctactttgacatttatacacataagtttaccatttagatggtaaaggcaggctctgcaatgaaaatctttgacagcaagggagtagttgtcactttacattaaatggaagaaaaactaaacagtagaagtctatcccttatgataaagaatggagcatagttaagggttgcttcatacctttatcttaaactgattagttggcaaataggtcccttgtttgtttcctagataaattttctgtattctctggcttctccttttatcctgttaaagacacatactccacaacacttgaataaacaaagcatttttatgttcaaattatttctgtatgtgtctcctttaaaaaccaattatcttcttaagggagagactcacattttaaagtctttattttcatatctcacatttgaggctgatattatgtctgtattatcaataaacacttatttaaacaataagcttttcaaacagataaatgaattgaagccacatggcttatagatttctgcttttccttactttaggtatctggatttcatctgccggttgtaaaagttactgtgctatctaatttttctctattcacagtgcataatcagggtcttctttaacttattggagactgtgaatcagagatgcaaatatcctattttaaaatattaaggactcgagttgtataaattcgtgtacagatgcctttcagaaattaaaattccatttgtatgtatatttagaatttccttttgcagaaagagtggccaaaaataaacatcttacagaatttcagcggaatagtgaagtggtcaattcataggggcatgtcaaaattaagaagggatttgactaaaaagttggtactttatcattttgacatcatattttcagataagataaggaactattcagggagagaaatagaaatgctatattctatagtgattctagggatgtttatatcgccatagcaactacaagggactatggcttcctttttagagggtcagaaactataaagatcacttatttctagacaaactaaaatagtaaaatactatcagagatctcatctctgactttaaactatggaaagtgctacagcattttctttggtgcacataccatttttctgtgtgcagtgccttgaggacacgaatatgtgcagggactttaaaaaggatgtatttcctggactccagccaattttgacagcattctctgagaatgcaccaaggagctattatctagatatccagggagtgtgacatcccctgccccagtttttgctttttgcttttctcctttaagatagaaagttttcccgcgttagtaacatgctgtacagcattgctaaaaccgttcataacttgatgctgagcaatgctacagcattccaaagaattggtagctccccagagactcagattaaaatcaggaagctttgcaagctcaaatcctcagagagtatacatacacacacatacgcacaaacacacgcataccatatcaaagccataactggataacttttatatgctgatggggaagatcctttatctcttcccttgaatgtttttctccatgggtgcttacagctatgcatttaaagggtttgggcctgctatgtactaacaaatgtgattggttgcccaatgtgaatttaagtaatcagcctttcattcagctggagtcttggtatcaggtggaggacttggcagagttatgtatctttgccattggactggcagccaagcaagaatgatggagacagtgacttaaaagaattcagagttgaatcaagtacttgtgaaatcaggctgcccaggtcaggcaagttaacagaagcagccaagaagatatgttggtgcacgtttctggtacctgacctaatcaggctagcggagtagccctaaacattccacccaagactccaggcttggagccatcagaagatggtagtaaaattctaccaggtaaataaaagtaaagaaataatactagagatacgcttgagttcaatggcttttagggcattaataacaggtattacatccattgtatctcttttattataatttcaagtgtattttagattcaggaatacatgtgcaggtttgttacatggatatattgtttgatgctgagatttgggatatgaatgaccccatcacccaggcagtgagcatagtatccaacagtttctgttttattatgagttttgtttttatcaatatgaaacttttcttcaataagcaagcctctgatgtcaaatacagcatactgcaatgtcgtacaaagctattttctattttatagtgaaagatgatgacagcaaaagacagtctggtctgcctacatttatgttttccacttccaacatgctgttgttgctctcgataagatcaccaatgacctcctaaattgcccgagctgacttttccctcctggtcctggctgcatctgacttgttgacaactccctccctccttctggttctcttcctgggtctgatgactattattctttagggatactcatctccttcctctgcccatgctttccacataggttcatctttatgctacctttcttctcactcttttcaccctaaacacctttcctgagcaatctgaccatccctagtcttattcaacatcacacacattccaatgactatcaattctctatgtgaaattgctaaaagacagttttaacctgcattcctccagataagtaaattctcagattgtttctgtgttggcttgttctttcttttgtatggtaatacctgacctgtcagataagtactttttccacagagttaaattgaggtgcgaaacaaaagaaataatgaaagctttccatcacaaggtgtacatagactggaagagaatgccttgaaattttattttaaaaacaccttctttctctgaaattcactcacatcacccataaccattgtatcttatcctgttgctgagctgataaataagacacgagaacacagttgctttttataaggttcccattgtaagcattgacttttaccttttacaactgacattatctgtagtctcacctgcctcttcagcttagttcttgctcaaggcaagtcctcgtggaccacaaacgtgaaatcttagaataaggcagaaaatcctctaagttttattgttaacttctttcctgtttccctctctgattgtgaagttttcttcagagcccgtcatctggaaagctgtacgatcagcagcagtcactccctatctaacacagtctccaacttacaaatgattaaaatgcttcccaattttgactgaaaataggcaagaatattccctttgttttgggaggctgaggcgggtggatcacgaggtcaggagatcgagaccatcctggctaacacggtgaaaccccgtctctactaaagatacaaaaaattagccaggcgtggtggtgggcgcctatagtcccagctactcgggaggaggctgaggcaagagaatggtgtaagtaaacccgggaggcggagcttgcagtgagcctagatcagaccactgcactccagcctgggtgacagagctagactccatctcaaaaaaaaaaaaaaaagaatattccctttgttgatatttgttaaaatttatatttatctagtcaggaaacataagatctctggatgagagaatacatcattaattactcaaaagcatctcagggcaagatgtttatctgtgagtgcaggggttgtagtacaggagagaaatcccagaattgtggatcttggagattatatagagcacctgatgtatcaggaggagagaaagtgagagagacagacatacaggaagacagagactttgctctgggctataaaccaatgatctaggtctattatttttggaatataagttgaaatgtaatcaaagggctcttggagataaaagtttttaaatctctccagagcaatgcactaaactccaaggtacgcttgccattcagtcaccctttaagacagttactacaactctttgctcagaaagcctagtccatgtatccaaatgtgaaaatatgtatggctcagcaatccctgccatcttactcctcttctcaaaatctgatttcaactgcctctggaacatctacagtttgatgcctcaaaggcttttcagaatgaccatgtccaaaattgaactgatcacttatgcacacatacacaagcatgtaaccatggaacctcttcatctgtctgaaatcctgttacccaatgacaccacaaatcatgtggatgcccaggccagatacctaagactcattcaagttcttcctcttcttcacccaacacacagtcactgaattctgctgagctgttttcctaaacttccttcccacttcagctcaaatgtgaatagcaactagatacttgattcaattaatgaacttttgttaagactgtaggtgtgttaatggtattatatatgtactttccgaaaaaagttctcatgagagaatatttcagcaagagaaaaatgctgaagtatttatggagaaaataatatatcagtttgtttcagaataatctagttgaagaggtgagtgggtggattgtccatggagtcataacagttggcactggattatagggttatgggagctatttgtattattttcctactttcaaatatatttgaaatcttacataatgataactttttaaaaatcatagttccccattagctactgaagtacaggcagaattttctgttgagattcaaagcacattattgaacatcctcagcctctgtttcatgccccatcttcccctaagcttctatgttactgaaaaggcagccaaatatgactgcgcttgttacctagctttgcgtgtgtgttacctactagctctaatgttcttcccacttctactactcagatatgtctactgcaatttgcaccttcttcgtgaattctttcctgagcctatgaccaaatatatgatacatgttttctctaacttctagaaaatgtttggtaccacttggaacactcatttcttccttcttctcatccagctaaggcttctatacttggatttttttcttcaattcttcaaaccatatcctttcttactactacaataaaacctacttaaaacttcttaaaggcaaactaaactgtgtttcacccacctttgtttctgctatattgctccttacacatgggaagaactcaataaattttgctcagtggaccttatgtataatttagatgatcaaaataacaaaattcgtactaggaagaatagccagaatgtagtttttagcaaatttattgagaataaatatgtttagatttttctttcttcccgtataacccatttgtggtttgtgatttttccgttaaatagaatataaacaaaacattatggattaaatttatgggaccatctattcatttattcaacaaaaaagcttttgccatctatcatgtgccaagcacaggtttgagctttggaagcccaacagataacaacatccctgtagtcatagatttcaaattagtggtatataccggctacttgatatatattttaatgttagtaataagtactataaagaaaagggaagagtaatgccaggaataaagagtgattgctggtgctatttaaaatagagtagtagagaaggcccctttaacgtgagaaagaagtaagggaaccactgatagaaatgtgggttaggaaaactatttttggcaggtagaacagcaagggcagaaatcttgaagcaagaatgtagttgttatactcaagtaatgcaataaacctaatgagggtgaagtgttgtggactatgaagagactgggaagagatgagcttggaatggtaggtagtatacaaccaagtcatgtagagatttataggtcatagtgaagattatgcttttttaaaaaaagtaaaagcaagtttattaagaaagtaaaggaataaagaatggccactccgtaggcagtgcagtggcatgggctgcttgactcaggatacttgtagttatttcttgattatatgctaaacaaggggtggattattcatgagttttctgggaaaaggagtcagcaattcctagaactgagggtttctcccattttagaccatattgggtaacttcttgacattgccatgcatttgtaacctgtcatggcactgctaggagtgtcttttagcctgctaatgcattataattagtgtataatgagcagtgagaaggaccagaggtcacttttttcaccagcttggttttggtgggttttgactagcttatttacagcaacctgctttatcagcaaggtctttgtgacccgtatcttgttctggcctcttatctcatcctgtgactaagaatgcccaacctcctgggaatgcagcccagtaggtctcagccttattttacccagcccctattcaagatggagttgttctagttcgaacgcctctgacatatttcccctctttcttttacaagggaacccttaatcctaagggtagtagagttacccttaggattaagtagtagaagggtaatacatcttctgtaacttcttcaggctgaatatgggtgatgatatttctgcctaactattagggtctcttgtattcagggtagagaggagctcagtcagcaagcatcagcttggtgagggccattcataactgataaatggtgatatctggaagattagtaagttttcaatctaagaaaacattgagtaagcttattctgcattcctatacaaaaagtaaaacagcaaatatattccacaacagtaaaacacaataagtaaaattatcccaagtaaactaaattagaaggctttccgtgaactgggcagctgttggaaccaaagtgatgtggggctgctagctgattccaatacatgcccagaattagaatactgatccaggtttttatattacccatccttcttgtttcttctgaggtgcagtcagagatcactggcaggttcacaggaataagcaggatcagtctatattgcaggaaaaaactcaaaaacagctgacgagactaataacaggtgtaccatagttcttaaaacataatttttttctctctccagtctcccatttttactaaagatggatcatcataggactgatttgctttattatacttggcctgattatttgtataaagtgttgcaagaataattatttttcatgtaggcttttgaaattggctgtgattgaactctgtgatgaagagccaccagaagattttgagcagaggagtgatatgatcccaattatgttttaaaagaatcttttcggctcttgtgtggagaattatccagtaggggggaaagagcggaagcaagaggaccatttagataggtagttctataacccagatgagagacaataatagcttctatcagatctgtagcaagaaaggtagtgagaagcagtcaaattctgcatatgtcctgaaagtcaagccaaaacatttgcccaataatttgaatactggagactgaaaaaattaaggatggctccaaagttgtcaatctgagtaattgttaattgaattactataattcaattgaaatcagtaattgccatttactgaaatgagggaatctatgggatgagaaggattaggaaatgcagttcagaattttgtttgcgtcatattaagtttgaaagtctcgtgagacctccaagtgttgagaaattagcatttgttagactggagttcggaggagatgtccgggcttgagatacacatttgggtgtcattgtcttatataagatatttaaaattatgagaacaaatgggatggattatggacagagaagaaaagaagtgcaaatactgagtcagagcactctaatattaagatcaggatgagaaggatccagcaaaggaaagcagaagaggtcaggatacagaagccaaatgaaggcagttttaagatgtagggagcgatccactctctcaggatgaggtctgtgatttacctattgaatttgaacatgtcaaagtcactggacttcatggttattaactttaaaaagtcaataattaagaattgcaacaccatttgctacctttgggatttgtatatatatatatatttttctctttctatagacagctaattcatttttttactgttttaaaatttttatattacagaatataaaagatagtctacaacaaagctcaggtcggattgacattattcatagcaagaagacagcagcattgcaaagtgcaacgcctgtggaaagggtgaagctacaggaagctctctcccagcttgatttccaatgggaaaaagttaacaaaatgtacaaggaccgacaagggtaggtaacacatatatttttcttgatacttgcagaaatgatttgttttcagggaactgtagaatttatttcagtaccctccatggaaaaaagacagggaaaaagaagtatcactctcattgaaaaatggtaagtaaaatgagaacaaataatgatgaacaattcagacaaatgagctgaactgtagaaattattcagtattaaatttagcgttatgttgaagcattatatcttctaaaatttcaggtaatcgtaaatcagattggggcattgaggtgctataaacagttgttcgatataacatatttatctttagtcaaatctgtatctacaaatttataggagtttgatacttagattaacatgtttaaaatactacctatcaataaaaaaattgattttcatttatttatattttggagggtgacactttacactttgcattaccctcccccacatttttttttgccatggggaatttgttaagttgatttaaaatcatgtttctttttatcttaattgaaatatttagctgttgacttaattggggggtggcagaaattcaattacattatttagcttcacatcacaagaagtggattactctttcttttacatttttagattaaaagtaataaagttctctaacagcttaaagtgattcatttcagaagtctttatcctcaaggtaggcttcttaattattctcagaggaaatcaaatcattcgtctaataattatagggaacctccatggtatctcttacatctgtccatttctaaccatctttactcctattttagttcttggtttactacatcaggcacctaaagagagatttctagcattaatctcagttgtctcaagtgattatctccactttgttctcaacgatctttcagtggccgtcatttttctaaagtgtaagagctttggtactataatctcattcccttgagaatgaaaccctgactccttaattgtgcaaaattatctggtcagcctcactgcttatttcttcgtgcctgccctatagcaagcccctccaattatgttctagcgatattaaatcaatttgcagatgcccaagtgttttgtactccctctgacctgcctgttcttcaggtctcacttcagatgttgtctttttctagaaatcctaaaactattagtcgctcctaacatctggaaacttggatattgtttcatcatttaatgtaatttaatatcaataaatcatttatgcatttgtaaattttccagacttggtggctaccgtgtagaatatatgatctgatgtgcctgctcctaaaacctaacacatagtaatcaatttgtttacttttctgcctcccacacaagctccttatagaaaagggctatgttttatttgtgttatatgctcaggactgatatagtgctgagcacaaagtgggtgttcaatgtgtctggactcaagcctcctctccgaaacctgagaatatttcccctttggatagtctaccagatttatctcactgcaccttccagggcaggtgcggtggctcatgtctgtaatcccagcactttgggagtccaaggcgggcacatcatttgaggtcaggagtccgagaccagcctggccaacatggtgaaaccttgtctccattaaaaatacaaaaatgacctgtgcgtggtggcatgcgcttgtagtcccagctactcgggaggctgaggcaggagaatcccttgaacccaggaggcagaggctgcagtgagcccaaatccaccactgcattccagcctgggtgacagagcaaggctccgtctcaaacaaaacaaaacaaaacaaaaaaacagatttatctcaacttccttgaaaatagctggtcccacagtatccaaagccaggcttgataaaggcaaagaaactcagccactctgtgtatatgctacaaatacaaacttaaacttataaaatggtggctcatgcctgtaatccctgtgctttgggaggctgaggcaggagggtcacttgagcccaggaattcaaggctgccacgagccatgattgtgccactgtactacagcctgagtaacagactctctctaaaataaattaacaaaaatatttgaataaacttatatcgccaccatggtgtactttctcccagcatttcacattgagacattatgaggctctgcgggctactccaatgatgtcagtttcattaccatcttttgggatgttcattccactcttgggaagttcttccccctctggtttgtcttcttatagtcagtgttttctccaagcattctaggccacccacaccatcccctaaggaccgttgaggtttcttggatagccagtgattactgtgcttctatatacacctaccagttttgcactaaagtagaaataacgctttctgctttttgaggtttctcctccgctttactcatgagtaatttttggcaaatgatccaggtattcccttctcactgggtcatatggacatttccctttcagtttaccttcaccttagacttaaacagaaacactaacgccattccacagagagggtcgctgaaatctcaccccaactctgaggacttttctggttttgacaaaggatagagtttctctagccccaatagatccaccctgtccttatccagaggttgaaattgtacttccattgacattctataggaattggtcaggagctgttaaatttcctatgacttttagtacaatctcagatacaaactgttttaagtaattgcttataagcacaggctctagagttccaacccgttttggaattctggcctttctgctatctatgtgcccttgagcaagtctcttaaatcttctgctccatacatttctgatgtataaaataggataagaatagtgtctatgtcacagggttgttatgaggattatctgacacaatatatgtggggagcttagtgggttgcttaaacacgataatggctcagttaaggttggcaattttgatgatgaaaatggtgatcttatggttctgatagtcatgatatctgttaattcattcttacatgctttcaaatttccctgagaactacagagagaagaattagactcagtccctgctttgaagagcttcacagtcttggagagaaaaggcacaaccagccagtaaaataagggttgatagactggagctgtacaagagggcaagaacaagatccctggggaatggaatgaagctatcttactaagaatggggaataagtcaaggtctatagaccattcaaggttctgagttacaactaacagaaagtgactctagttactttaggtagaattatataaattactagaaggatatcagatacctcatggaatcaataggaaagcctgagagctaggtttaacaatgggcagaaactataaaggaagagcaggctaggcatccagaatatatctactatcaagctatgaggtaaatctgaattattttgctgtcatgccagagtccattgctttaccaggagcaccattgcactggacattgcttgctatcgtcactgcaaaaaaaaagtatctaaattatttattcttgctgtgtgtcgctcattctacaactagggtctctggcagaagcatctgatagtcagaggatggatatttttttctgtaaaggggcagttagtcgatatttttgtccctgcaggtcatgtagtctctgtcacaactactcaactctgctgttttagggtgaaaaaaaccatgtataatatataaatggatggacatgttgtgtttaaataaaactttatttaccaaggcagatggcaggctggaattgctgatgggccatagattgatgactgctgttacaatacaggtttaggccacagaactaggttcttattgccagagatcagggaaaataaatagctgaatttgttcttcattgtagtggcagtcaacacctcgtgtcctactaagtcccatacaatggtagattcttgaatccttggagagatttagaagctatgcattcctgaatacacaaatgttcagtacagccttcatgtggtgttctcaacaaaaatctgctgagttttttagtaagccaatttgggttaaatcaaaataaatttgagctagtaagaagggctatattggtatttttcttaaatggtacatgtatggtagtattagctatgaccgcaataatgctgtgacacaaatcaccctagaacttgctgactgaaaacaacaggcatttctggctgtttaggttacttgtaccttgactgactcagctgggcttggccgggaagctctgcttcaagatgtgggttagtagagctaggttccatgatgcatgttggattaaggtctgctatatatgtctttgctctggacctaagatgaagggtcagtgacatgttttcatgaccagtcaccaaagtataaacctaaacctcccaagaacactcatggcctctgctcctgtgaagttcactgacatttgattggccaaagcaaattacgttgccaaatctgacatcaatagaatgagaaagtagactcttcctacagtggaaggggggagagatgttaatatttgctgaaccataattcaaattattagagatagttaataatttataacaggattgttttacagctagaaaatgccttagtggttttgccctgcttcattattttataagggagaaaactatatttcaaagatgttatgtgacttgcctaagcacatactaaatagtacatctgcgtatttctcgttcagtcatctctattaaatgtcataaggtaaaacagacattacgctttagatgagaacaggaagatatttaaaaagccagactaatttatgactgctcattcattatctaacatacctgcttccatacattgtctttcagcaaatagaatttcaacatgtatctcaacaagttacacatcatcaaagtattaaaagccttattttcacggacattctgattgttcactaacagtcaacacagtcaacagtaaatccacaagcaccatgaacgtatggatagatatgcctatatgtaagattactagttaactttttgggaaattaatattactgctaaattcagttttcattgattttcgggtgggtaactaactgcttataaaatatacctataggaaacatgtaaaaacaaagaatttacataagatctatctgggattagagaaacaaagctcttttcttctttcaatgaacacttaagaagggcctactaaatgtcagatgttatactctattgtcgttagtttctttctgataccatctttactatcctgtaagccattagtgagtgtttcccacttttagaaaatgacttcccaaagactaagagggtagaacagttcaaatgctatcatcaaaatgaaggcagtttctagactacaaattgctgtacagccataagatggcattattgtgtaacaacaaggtccctgtcaaacatcaagaaagtaatgttttaaaatcagtatttccttcttggaattctacttagtcagatatgttgggttgacttacccacccatataagtagttaaattcaagatggttctgagctttagatatgatgtaaaatagacatgagactaagagtatttatttctatattattacatttctatagcaaaaaaagaaacctctaaaaaaattagagaaagaagtataagggcatttaattaatcaaatgttcttattaataatatttcataaaataaaggaaatgttgaaaaataaaatatgaacacagtgttgtataaagtaagtcagaaataagagaacacttactgtatgaatctattatatgaaactaaaaaattaggcactttggagtttagaggtcagataggagttacctttgtgagttgtgattaacaagggctgaagcaggcttctagggactgggtaatgttttgtttcttgatgtggatgctgcttgcattgatgtgtttcctttagggaagtttatggaaccatacacttgtgatgtgtacacatttctgtgtgaatgctggactgaactaaaatttatacttacattttaaaaataataaatatgtactttaagtacaggagggacataaatcataattgttttaataaagaaggtgtagctttaggaaaagcataccgcattgttctatttttggcatttcaccatggacccctgaacattttataattgcccagtacagcctgtcagataaatatgtgggcactactgctttagagaaagtattttccaaatttatcaccaccattctggaaccacagttccacaggtcattaggatgctgagggtgggacagttggaagctgcttccccagggatttctccattgttcagttctcatagcagtaagcctgcagcattaaagcactcacaggctctggctgccatttgtgctacatgaagaaaaatgagaaaatgaaagaaacgaaaggagagaaaacaggagtagaaaccaaataaatcagattcgaagagaaagtccctaatcgtctctgtattcagacagtagggaatgagcatgcaattctgcaagcccattcctaatgtgagtttctgataagaatttgctatctcagttgtaatctttctactgagacattcaataaataattttctttcatgtcaaggtaaggaaataacctcacattacccatataaggaaagaatagtatactaatcctcacgttatcactatagaattttatcttttaaagtggaagctagagggacagatgcataatctgggagcttttccagaattgtttgttcctaaatgagacattcagctatagcagcattagcagcctcttctatttgtcacaatgccatatgtagttgggaagatacatgataagcacatacaggatgctgacaactcacgaaggattatcattgcagtcttagaattaatctctaccatatttgaagatttttatgcaagactggatcttcattccacaacccaggtataggtatatgtgccaatacaaaatacttactgttggtttctgagcttggtagaattaggaagtaaggggtaaaaaacaagcaagtcctgaacttaagaaagttgttcatatcctattccatggccactgttttactgactggaagaaaggaatcccgtggattcagtcatggggacaatgcagaagaagatacagtagacagacagagaagtacaaatttctatttatgttccacttttcaaaattttttatctttaaatgttatttttaacgtttgtgggtacatagtgtgtatatatatatatatatatatactgtatatatatatatatatactgtatatataaacacacatatataaatatatactatatataaacatatactatatataaatagatttactatgtatatacacacatacatagtgtatatatgtggggtatatatatatgtggggtacatatatatatgtggggtacatatatatatatgtggggtacatatatatatgggttacacatatatatgtgtatatatgtggggtacatatatatatatggggtacatgagatgttttgatataggcatgcaagtatcatggaaaatgggatgttcatcccctcaagcaattattctttgttttacaaacagtaaaattgtatttttttaattgtttaaaaatgtacaattaaattgttttgactatagtcaccctgttgtgctagcaaatagtaggtggtgttcattctttctaactattttttgtaccaagtaaccatttcaacctccccctcaacccccccactacccttcacagcctctggtaaccatccttccaccctctatctccaagtgttcagttgttttgatttttacctgccacaaataaatgagaacgtgtgatgtttgtctttctgtgcctggcttatttcatttaacacaatgacctccagttccatccatgatgttgcaaatgaaaggatctcattctttttatggctgaatagtactctattacgtatatgtatcacattttctttgtccattcatctcttgatggacgctcaggttgcttccaaatcttggctattatgaacagtgcttcaacaaacgtgggagtacagatatctctttgatatactgatttgctttctttgggatatatacccagcagtgggattgctggatcatatggtagccctgtttttagtttctgaggaacctccaaactattctccattttggttgtactaatttacattcctgccaacagtgtacaggagtccccttttcttcacactctctccagcatttgtaattgcctgtcttttggatatgtcgttttaattggggtgagagaatatcccattgtagttttgctttgtatttctgtgatgattagtgatgctgagcatattttgatacacctgtttgccatttgtatgtcttcttttgagaaatgcctattcgaatcttttgtctattttctgatctaattattagactttttcctatagagttgttttaactccttatatattctggttattaatcccttgtgagatgggtaatttgcaaatattttctccctttctgttggttgtctcttcactttattgattgtttcactgcggaggagctttttaacttgatgtgatccatttgtctatttttgcttttgttgcctgtgcttataggatattactcaagatttgttttacccagacagatatcctggagagtttctccaatgtttccttgtagtagtttcttagtttgaggtcttagattttagtcgttaatccattttgatttgcagttctctgatggccagtgatggtgagcattttttcatgtgttttttggctgcataaatgtcttcttttgagaagtgtctgttcatgtccttcacccactttttgatggggttgtttgtttttttcttgtacgtttgtttgagttcattgtagattctggatattagccctttgtcagatgagtaggttgcgaaaattttctcccattttgtaggttgcctgttcactctgcatcaattttgcatcaatattttttgcatcaattttgcatcaatatttatcacatggtagagttcagcagtgcagccatcgggtcccaagcttttctttactgggagagtttactaaggcttcagttgtgttactcgttactggtccgttcaggttttggatttctttatggtttaatcttggtaggttgtatgtgtctaggaatttatccattacctctagatttttcaatttgttggcatatagttgctcatagtagccactaatgagcctttgaatttatctggtattaattgtaatatctcctttctcatttctgattttacttatttgggtcttctcccttttttcttcattagtctggctcaagatttgtcaattttgtttaccttttcaataaaccaacttttcgttttgttgactttttgtatgttttctttattacaaagtcatttatttctgctctgatctttattatttctttcttccactaattttgggttcgatttgctcctgcttgtctaggtctttaagttgcattgttaggtgatttatttgaagtttttttcttttttgatagaagcacctacagctgtaaatttctctcttagtactagttttgctgtatcccataggttttggtatgtggtttttctttcattttttgaagacatttttcaatttccttcttaatttcttcatagacccagtggtcatttagtagcatattgtttaacttccatgtgtttgtatagcttccaaaattcctcattgttgatttctagtctcattccattgtggtcagagaagatgcttgatattatttcattgttactgaatttttaagactgcttttgtgacctactgtgtggtctatctttgataataatctgtgtgctgagaagaagaatgtgtattctacactcattgaattaaatgtcctgtaaatattagatccatttattctatagtgcagattaagtccaatgttactactttggttgagcttctgtctgggagatctgcccaatgttgaaagtggggttgttgaaggctcctgctgttattgtattgaggtctttctctctcctgagctcgaataatatttgctttatatatctgtactccagtgttgtatatatatttgctttatatatatatactccagtgttgagtgcatatataattgttatatcctgttgctgaattgacccttttgtcattatataatgaccttctttgtctcttcttacagtttttgtcctgatatcgatttggtctgatataagtagagctagtccagctatgtttgggtttccattggcatggaatatctttttccatccctttatttccagtctgtgtgtagctttataggtgaagagtgcttcttgaggtcaacacaaaattgggtcttattttttcatccattcagacactgtatctatttttcttttcttttcttctctctcttttttttctatctttctttcttttcttttctttcttgagacagcatctcactctgttgcccaggctggagtgctgtgacaggatctcagttcgctgcaacctccgcctcctgggttcaagagattcttgtgccttagccccccaagaggctgagattacagtcacccacaatcacgcgtggctaatttttgtatttttagtagagttggggtttcatgatgttggccaggctggtctcgaactcctgacctcaagtgatccacctacttcggcctcccaaagtgctaggattacaggcgtgagccaccatgcctggtcgagacactgtatctctcttgattggagagtgttgtccaggagctgagcctagaaatgggtcctcacaacactgtccagtgccctatcctactgtgactaagctggtatccaagatgcaagacagaatcctctttacttttcactctcctctccttaagcaaaagtaaggagtcacttttgttactgtgggctgcactgcttgaggtgggggaggaatggtgcaagcactcccttagccatgccagctggtgtctccctaggtcacatgccaccctagtcctctagctcttagcccaggctatgactagaagttatctaggaattgcagttcgtgtgtcccagactgcctctcaggtttacctgggactccagagcactttggcccacaatggtgaggcttgccaagaaacttgagttctgactgctgggatgggcgattcccttctggctggggctagttcaaatattccctccgtgcacaggcactgactgaggccagcatggcttttttctctactgtgacagcacagcagttagttcaatgtaaagtcccccagtagctgtactgtcccttccaaaagtgcaaagattccctctctgcactgcacgtccagtgctgggtgattgggaaggtgtggtgttggtgattcaagactgtgtctcctgcctttcctcaatgcctcttttagcaagatgaagttaaaaccaggtaccatgattccgtacctggtttttggttctggtgacagtgcttttctgtctgctcatagttgttacaatttgatgtttcagtgagggagattagttatataggcttctattctgacatcttgcaccactccgtctcacttttttgaattgttgaaaccatggtttatggggaaatgttctgttctggtttttaccctcaagatcttctttgaaaatcatgatttactaagtaactagttggatagaattcatttttaagaaaataatgaataagtagttcccttagatatagcaagcaatgttcttataaactgacacaccaaaacacttaccagttcacctaaacactgaaagtatttaaaaatttatttttaacctttaagtttttctccatttgagtatcttgtgcactatacgctctcctacatatgtctacaatctttggtctgatttattttattggttgttgaatgtcagaaaccacctgaattttgcttgtatatataatgcccagtagagtgcacattggtaatcaatacgacttgatgataataatggtaatgaacactataatttgatagcatcaacttggcatgtatgccagaaataaaccatcataaacttcgagaaaaacaagtctcattaatctgtcatttattataatctccctccatcaagcgtagcctctatatactgtcttttttgccatatgtaagtttcttcttgtatatttcagattagagcttgcctcctcccacacactatcttctatttcacactgctctgttcaagtgtttatgtttctgctgaaggctgtataatctaagataatccctagctattgtaaatatcattcactggccagtcattgcattttgcacaccactgagagagtgattgtgagccaaatagaggagattttgtttccacccagcaacccaaaatgaattgtgtgatttgactattgatgccaattacatggaagttttactaccagaggcaaagctttaaactgcaaaagattaaccccatatagttggtgtcatgaggtatttaatgtatattggactatcaaagcgtctccttacaacaaaccaattatcaatgaataatattcttatcttattgtgacttattgaaactctttaaaaaacatgaaccattcagcacactataccgtctaaattagatatctaaactagccttcatttacatttccttgtttagttttaaatataatttcttctgaattcttagttgttaagagcaggtggtgaaagaatttaaagaagaaaatttgttgtatttattaagtgaaagagctttttgaaatgcattaaatagaagtttgtttctgcccatcagcttatcttctgcatattcctatttatagttcaaagcacttaagagttgcagagtgatttgctttttatgatcaccgcttcatccaggatcatttgccttatatcttcaacattttcagattcttataaatcttcacagttcacttagaggttagtttaaaactttcttcagataagaaattgactagatataaaattcacataatctcagagttagccatagatcaatatccccagtctttttctcaaagtaattgaacatttttgtttcccaggatagttgtatacaagcattttcatcctcaccatagatgattcttgttcttcagtatatgaggggactgtatttgcctgcttgttatctaaataaacatttttattattgtcaaaggaaaaagactctaatacagaaagaaattttgtgtccataggactagcctcattttggaggctgatattaatatttgactttattcattgtgtatttcttggttttgtcatttcacaaatttcccttctctaaatatgcattttttctctacctggaatagatgagttttaaaagacattactgtaaaataaaactgtgctaaatgtacttttcccagaaactctctttattttatcaattataatttgctttggctaagtgttacagaagctcaaggtagaaatgacttaaataaaagagaagcctatttctttctcctgaaaaaccctggaagtttgcagccaaggcagatatgttggccccgctcatttctgttttctactgagtgagttatctttacttggtggaatttcatccacatgttgcaagatggagctctcatgacatccacattccaagaaggatgtaagaaggccagaagaagggtcaaagggtgcataccaattgtcttttagggaagtttcgtgggagctgccatgttatatttccacttacgcttcattggccagatgtctgtcacatggccacatctaagctgcaagtggggctgggaaatgtgtttatttcacatgtgctctgctaaaaactgttcagtcatgaaaaaaaaaaaaagaatattggaagagaactaacagtcttcaacatgtatatttaaaaagagcgttatttttcttttacttatttatttttttttgagtgagagtgttgctggggctggtctcaaactccctggatgaagtaatcctcccacctcagccttctgagaagatgggattacagaggcacaccactgcacccggctcctgttttgttttgttttgttttgttttatttaaggagccctaagaagagtgtaaaaagggcaactttgtctttagttaacccttccctttttttttctttcctaattttatgaactctgattcagcccgcatcttactctggcttactaaattctgccaatataagagtagaagttttcatcatttccctaggtacctactcttctgtttctccatattctcaaagtaatttctcattcatcaacttttgtctgacttagatttaagctactgcttaggaaatgtgagaaatggagaatttggttgtcatagcgctcctacttagagggctaatgctttcctaaattttactaaagttggatcctaagttatataagttacctaaatttaattagcaagttttgcttactaattcactgactaaccactataaaacaaggacctaagtttaaagctgatattatgacaatgtactgaaatttcaagacattactttttctggacacgtaggatggaccttgcataagataaaagagcttatttttaggcacacctatgtgccaggcatgggttcagagccttacatatatcatttcattctcaagagaaccttaattttagagacgaataattttgagttttagaataaataattgtcttaagctcacacatgaagtatgtgccagagtctatatcgtgaccccagttatgaattcttttccactacatagcctgcctccatggcatttcacataggatttcttatgctcaaggattatgttcttccttccagatctatagacatcagtagaaacaacacaaatacgtataatgactttttaaagtctcatatacaagaccaaagtactttaaaaagatgtttaaatttttgaaggtgatatctttatgttcgagatcagtagcagaaatggattgtaattcattacaagatgcttagcaaagccaagtggtaaaggattttctgatgtgcttgaggagtcctgacttgctccttagcaaattcctacacaccattcagcattcagtgcaaataccacctcttggaatccttctctgttcttgatcaattattccattgtctggattcatagaactctctgtttacctatttatcttacaggttattatcatgagtttatatgtcttacatagctgtttgcaacatgttaccattcagtggagtactttttcctacagggaagaggctgtactatataccttttgtcacccctaagtggaatgcagtatggtttcatgttagatgttcaatacatgttaatattttattgatgagcccttaaatgtatataataagcttctcactcaaaagctgtaatattctagaatgaataagtttcttgagaaactctttggttaacagaatctccatttccatcatagtgtattcaataaattattaatgcagggtaaatttccttatatttcctttcatttcgctatactaaggtcaaatcatgacttttaggtgtggatacagcaatatataaaataatctaagacctggatatatgtttttctaattagggaattggagatacatgaacagtctctcatagagaaaaatatatccattagtcactaaagtcagtataacattctggtgaaaggtttgcttgcttgcttgtctgcttacttgcttgtttcaccttctattctaggaggatgtttgtcacaattatgaaattctaacgctttaaaaatctgtttaccctatgaaagttgcaaattcttgcctgtaaggcaattttcacaagaattattttcatattagttttagtttatccgtggatagtctcaaattcctcttgaaaatatcagtgttctcaagggaaaactgcccattacaagccacagatgtggttttttgagagatttctgcctgaaatacaagttttaaaatattctttgtagtttcctagtatggctagatacttgtaggaaatgacaatttagatgcacatttgaaaattcttagcctttgagtaatttatatgtttgaataaatttaaactatctttgttcataaaaaggcaaattttgtctgtttgtcttgaaatgcttttttagtttcttcttcagttctttcacttgtctttctgtaatattcaaaattatagcatagtacttgaaaaccaaggatggtccagtctgtgtcctttgttttgaaggaattttggaatcatcagagatataattctggaatttctttgggtaccttccataaaatagtagcatcctgataaggacgtagatgctaacttttatttttatctcattttctttcccctatctctcagtaatgtaggagtgacccaaggtagctgtttattgggccctcaccaaagtcaatcaatattagtcagctacaaccacaataatgctgtgtgacaagcataccccaaaagaacaataagcacttatcctcatattcacaggcctactttgagtaatctctgattcagaatctgactgtaggttgaccaaacatgtctgatctatgtgtctcattctggggctcaagctggaatggcagtagatatttggggcacattcctccatggctgagttctaaagatctcagaagggtaagcagaaacacatgatggttcttaagacccagatttataactagcgttctctcttccatccatagtcaattgtcaaagcaagtcacgtggcatatccaaagatcagggatagagaaatacacttggcagttagtgaacccatttcaagagtgtgggtgtataacactactacaaaacagaactgagacttgcaacttgaaataccacaccattctagtagaattttattacagtattaattaaacatttttgataaaacacagacaactctgttagaaagcccaacttacaatttgttgatcccacttggaaaggtattctgaatccattttttcacaagttttctttctaattcaatgtgttggggtacttttattttacccagaaaagtaatattataaagcataaagttaatgccccctgtaaaaatagaatactgaaacaaactttaagtcacaattttattatttactgacttgagaatctccttgtgcttcagcacacttggtagttggatttccaaatagcatcatgactttccatacccagctgtctgctgctcaaaactaccataagctgactatcacagctcacaggatacccttgaagaagaccatctggtttatgtctcttggcaaaatttgtttaaaaacaagcagctgcatgacaaagtaagaaagagtctctgtctagctgtggtaaataagtagctttgcaatactcataataaagcatttttctaatccaagccaacatcttcaaaaggaaagcattattttcttacaactgaaagaaaaatctacagaattcagtgatgagggaaggactccattaaatttgtttcagcagcttgagatagtgagaaaaacaaaacaaaataaaaacctgtttgtgattagatacagtcttgtaataactagttttaaaagtatttatttagaatctaatacttggatattattttaattctttatattaagagatttacatttcataaaagcttgtcctttgaaccctaatactcatattgtgatggtgagccggaatgagtaaggtcacttactatatagtcggtatataataattcgttgaataactctctctcctcctgttactggcagtgaatccatacgggtcttcagcaaccttaattcatgcctcctcagaagaaagaattcgaccaaggaggcataaggcagaagaagagactgaggcaagtgttagagcaggaatgaaagtttatttaaaaactttagagcagaaatgaaaggaaataaagtacatctggaagggggccaagtgggcgacttgagatattaagtgtcctgtttgaactttgatttatggttttgtattttggcatacttccatggtcttatataccttctccccaattcttcccttggggtagggggctatctgcatgcacagtggtctgctgacacttgggaggggagcatgcacggtgtatttactggagttgtattcaagaggtgttcccttaccagtcaagtgtttccagaggaaggtcgtataccagttacactatgacattttgcctcttagtgcgcacgcgggagcccatttgcccaactcctgcgatcttatcgggaagctgctgatcaccaatttcaggtgtttttatctattgggagactgcctttccctggtattggctgtgaccaattattattttaaagacacagtttaataaccacctgactgaccatcacttgatggttgcctgacattcctggttggggtggcgggggtggggggtctcctaccctgctcatatctgactagctatctactgtaacactactattaggtatgtctgtatcccattacactcactctctattacaaaaaagagtaccttattcatttttcaaaagaatgagtgaattttctgctccagttaagtgcttttccttacctctatgtagagtgtcaaactagccatgcttaaggattgattctggtattaataatataaattcttgcattatgagtgtctcagtttgggttcttacataagcaaatcctgagacaaggatgtgagttcaaatagtttctttgggcagtgattctaggaagctgtggtaggatgttggagttgtgagaaagttaagagaaagcaacctgtaaagagtatgttatcaagccaaacaccactgtgagaactagggcttaattccctggagaaagtctgggaaggcataaaacacttgtctcagagttatcttagacaaggtgcaggagctgaggtgtttatatttcaactcttgttagtcacttttaaagggccgctcagggtgtcagggtattaatttcctcttgcaactacttccaacctgtttttgcatgtggttgtagctactttttctgcgtcaaagatagactttaggctaagacatgcagtttccggctgtaggacatcaaccagagtaccctggagtgtccaggcccaagataatgggtgagctccacctggatctgtggcaatgtgagggaggggcattattaccctagcaagggccactgcacttccctatccagctggtcactcttctgcgtatttgtgttacttttctgactcctgcattcctctggatcctgattcaccatcagcttttgtattctgaggcttgtgtggctgtgtctttctatttcttccttattgacttacttgtttaatcttttgctaatgtatacctttgatattcctatgtactcacctttggttagctctgtgaattattgagtcttgctttacagctttaaaaagatcatagccatggtttgttttttaagtgtgattcataacagttagtgacaaaattagaagtggaaattaaaggtcacgtgcacaatcctacacaagccaatttcttgaacgacataaaatacttgaatttgtcttttactatcaccaatatagaaataatttgggggtatttctcaaagtattgatttaacaaaactttatttttgtgtgaagattttttcaagtctcctggaaattattcaaattattgtctttaaagtcaaaggaaaggttaatattagggttacttttctttggtcacagaattgctggaggcttctatgacttgctttgaagcagctgactttatgcacagttttggttagaaattcactaccaattccaacattttcaaagtcctaaaagaccaaaagtacaattcttgaaatatccctagagaaagcaagaataaattagttttcactagaaatgaagacaaatttttctcattagttcattttgcctcatgatcagaattctttgccacatgaaaatattttggttaataggttgtaacataaagagtaatatgaatagagatctagcccaattagatgacagaaaaagagcaaagcttttgaaatgtataaagaagaaagtttaagagagacatgaacaaggctggatgtagtttaaggttgaagaacacagaaaaatgagataagtgaagttaagtgaaaatccttcccttactgagaagaaagagaactcaaaattatgtgaaggtttttgttttactttgttttgcttcttaataaggaaacaacagtggcaaatctggggcattaggaatggtggaacttctataacagtgatgtttcaaaggtcacaaaggaaattaaattgtagattgggtttaaaagcactggaattacttccagccccattttttcaggattttgtatgtagcaggaaatagatcaccgcatagctaaaggggagaatttaggttttaactggtctcagtgcaaactgcttcatagttcctttgcatttggtggtgtatgtaaaacatgaaaggtataaacatttattatcataactttattattatacaactatttattggctgcataggaccatgtgtcttcttgcaggtataatcaaaaataaaaagacagaaatgtatcttatatgaaggctgccattatcgctcttatcaatggccataaaatcagatttcttacatgtacaacatatgaaaatatattaaatatgaaacgttttccattaaataattctgtaaatgattttcataacatttctgtccatgatgtgtaaatctgtagatcaaatactgcaagtgtacagaacttaaaatgctttggtcaaaaaaattctcttattaatatgacaatggcgttcaaaagtaaaaaggtaaaaatacagtttagcattaataagtaaactcagaaagtaaaatatattgatcatacagtctgtattagtctgttctcatgctgctctaaagaactgcccaagactgaataatttataaaggacagaggtttaattgactcacagttccacatggctggggaggcctcagggaaaacttacaaccatgccagaaggggaagcaatcacatccttcttcatatggtggcagaaaggagaagtgctgagcaaagggggaaaagccccttataaaaccattggatctcatgagaactcactatcacaagaacagcaccatggggataaccgcccctgtaattcaattacctccaactgggtccctcacatgacacatggggattacaggaactacaattcagaatgagatttgggtggggacatagccaaaccatatcatttcatccctggcccctcccaaatggcacgtcttcacatttcaaaacacaataatgccttcccaacagtcactcaaagtcttaactcactctagcattaacccaggagtccaagtccaaagtctcatctgagacaaggcaagtcacttctgcctaggagccataaaatcaaaagcaagttagttactttctaggtacaatggaggtaccagcattggttaaatacacccattccagatgggagaaattggcccaaacaaaggggctccaggctccatgcatgtcaaatccaatgaggcagtaattaaatcttaaagctccaagataatctcctttgactctgtgtctcacatccaggtcacgctgatgcaaggtgggctcccacagccttgggtagctccactcctttggcgttgcagggtacagcccccttcctggctgctttcacaggctagcattgagtgtctgtggctgttccatgcacacggtggatcaagccctcttctcacagctctactaggcagtgccccagtggggactctatgtgggggctccaaccccacatttctcttctgcactgacctagtagaggttctctctgagggccccatctctgcagcaaacttctgcctggatatctagacatttccatatatcctctgaaatctaggtagaagttcccaaagctcagttcttgacttctgtgtacccacaggctcaacaccacatggaagctgccaaatcttggggcttgcaccctctgtagccatgggctgagctctatcttggctccttttagccatggctggagtggctgggatgcagggcacctagtccctaggctgcacatagcaggggggctctgggcccggcccaggaaaccattttgccttcctaggcctctggtcctatgatgggaggggctgccatgaaaacttctggcatttcctggagacaattttcccattgccttggtgattaacatttggctcctcgttacatatgcaaatttctgtagtcagattgaatttctcctcagaaaatgagtttttcttttctattgcatcttcaggctgcaaattttctgaacttttatgctctgcttcccttttaaacataatttccaattccaaaccatatctttgtggatacataaaactgaatgcttttaacagcacccaagtcaaatcttgaacactttgctgtttagaaattccttccaccagatgccctaaatcatctctctcatgttcaaaattccacagatctctcggacaggggcaaaaagccaccagtctctttgctaaagcgtagcaaaagtgacctttactacagttaccaagaagtttctcatctccctctgagaccacctcagtctggactttattgtccatatcactatcagcatttgggtcaaagccattcaacaagtctctaggaagttccaaactttcccacatcttcctgtcttctgacccctccaattctctaggaagttccagagtttcccatactttcctgtcttcttctgagtcctcccaactgtttcaacctctgcctgttacccagttccaaagttgcttccacatttttgggtttctttatagcagtatcccactctctgtggtaccaatttactgtattagtctgttctcatgctgctataaagaactacctgagactgggtaatttataaaggaacgaggtttaattgactcactggtttgcatggctggggaggcctcaggaaacttacaatcactgtggaagcagaagcaaacacatcctttgtcacatgatggcaagaaggagaagtgccgagcaaaggaggaaaagccccttatgaaaccatcagctctcatgagagctcactatcataagaacagcagcacgggagtgaccaccccccatgattcagttacctcccactggatccctcccatgacatctggggattatgggaactgcaattcaagacgggatttgggtggggacacagccaaaccctatcactgcctttaagatctatgaattgtttttctacattgaagaaatttgtagacatttgttttttattctctttttggtttgctgagagcagtagtctcttggaagtgagtttcatttacattttttcctttgggtgtcaaatatataaaatattttttaaaatcaatggctgagggataaatgagggttggtagaaagggaaaggataagggttgtagttaacggaccatgttttaatgtgtctataattagatggaagttgtctcttaccattcaacatcctggatggccttcctatagaggacattttcatcttcttttgtcgtccagagctagcatatgtgtttcatgtctttagatagtgaaaatcaattcagattttcatggaaaatgctctctcttcatcctaaagacagaattgtcacggctatttcgtttattgaaaagtgaaacctgctacagttagcatatagttaattccatatatgttacctgtatcatttaatacattcacaaagtaaaaaaccaaattttgccaagttcttgatagtaacaatagtaaaatggaatttctgttggcatattttcatgttattctgaaatgctgaatggatttattaagattgataacaatatgttgtacctttatgttctaaaatttaataacagttattcttccaaacatgccagcgtcctcaatagttgacagtctgcaaaatattctattatgcaatcagccatatctccttcttgagctttctttaagtacttgtatcctgtatttttccctgaaatctagcagtaagttgaagaaatgataaacaaaattgtatcattgtatataatggctatttataaatactgatgtacattttcataatgttatttaaatgattacttcagatatgtatttctgttttctacattttaacttctcaacatattaggttgttatcttagattggattttctaagacatagactctaagacagagatttccatgcagatggtttcttagtgagtgcttttaagaaaaatgcctgggagggagtaaaggcagcaggattgaggagagagaggagttgaatgatgatgcagtgaaatggaagatcttatctggtcccatgtggggttgggatgaccatttagagtattaccgtatgaagcaaggaaggtggaccattgtatccctaatccattagtcattagatgtgagcctcccaactaccagcttccgggcaatatcatcttggtcaaagaagtgcctgtctgctgagagaaatttcttggaagagcttaggtatgatctgttagtagataacaatcccagcaactgggagaatgaatgcttcatttgtaattggtgaatctcggtggcacaccacagtgttcgctacggtaatctttatacttattgagacatatattgtttttaagtaaaacttgtatacctagtaatgcatttaggtagtgtattggccaagctagtcctttttggaaacaatttcattgtggtataaatgatatacaataagctacacatttaaatagtacaatttgataagttttgacatatgcaaataccagtgaaactattagcacagtcaagataataaacatatccaatatcctcacaagtctgttttcggtaatcactctctcctgcccctcccttgattcccaggttaccactgatgctgactggcattatagataagtttgcgttttatagaattttataaaagtagaatcatgaagtatgtaccttatttctggtctgccttctttcactcacaaactactaactttcattttgtgaataatatgatctccgtgtgattacacacattaagaaagtcaataaaaacattgtaatttgattccgatactagtttatgggtctacattatgtatttaaagatactatcatgtttggattagcccttaggtatcaagtaaccctggagttgaggcagttactgttttatttgctatcaatctttttataagctcaccttccactaattacccaaaaatatttgatttaatacctgagtacagaaaaagaacatattcacaatgtttaaattttataatttaatattataatttacaacagtttaaaataactagtcctgaaattgagtatttctcacctaatattctgctctatttattacccactccacgaaaaaatttcccagaaaaatcacaaacatgtctcttgagtgtattattacccaacccacagaagaatttccaaaaacagtcgcaaacattctctcttgagtgcaaccattttctcgggccagccattcattgaaacaaaatagcctgtataacttctgtgggtagacatttgtaggttgttcttttgaggcattagtgctattgcatttaagataaagaaataacgaattcacaaattttataaagttctcttaaatttaccaagtcaatagcaccaccactttgattcctataacctgtgacttagttaggcttctcaattccaagaacataccaccattatttcttataatgtcctcagattaaaacatgtgttgtcctttctttatacctccctgcactttaattgaatattttgccatttactggattctgtacactttttatgttttcatgccctcccttttcattctcctggacatcaatcgcaagtcagtagataccttgtaagagatctctctccacccaaatcactgtttcttttgaaagagttaacctttctgaagcagcactcctgcttcacatttcccagcacaggaaccttcagtgtttctctgttgatagctttgatttcaaacgggtagccccaggagaaaagagagctgaaggatatgttttgcttggctgctttgtttgacctgcaaggaacattaaaaggcaatgaaaccgggcagagactggactgatcaacaccatcagtttagcacttattgctatactttctaaggctttacaattttatgtgtcccacgtgtcccctgaaggcatttgattttctaacctcctaggccagaggctaacatccagaattcatagtctggcacttataaaccctaacttagcttctgtcacttgtatctctatgcaactctacagcaaaatgtacttattttctctaaaatacccttattccatacttctttggagtgtaattttatatataaaagtcctcaccacctgtaaacattaggaagctttgattcgaagaagcagaagccatctccatttaactgaagtgaaatgaaacttactggagggataatgtatagttcttggaaatgaaggaaaagaaggcaactgtggcagagggagggcagcactgagagtcaggaactccagggaagttactttttggatgctgtcattaaaatgcttcagcttcaaattgtactgactctacctttctcaattctagattcaaatttctaaatgtaattggcataaattaggaacttgtcccaccagtttatagagtttacagagcactatgattataggtccccctaagatcatgcagaatgagggaagagtaatttcatccaaggaaaagcagggtaccattcaccaaagagtggagatacttattcagaacaattaatgttagatgccacaaaaaaactaaccctgaaatcaaagtggcctaatgaatgcttatttattgctcatataaagtctgatataaatcaggtagcattccttcacagtgactcagggacctaaattgctttcatcttgtggctctgccatgtcaacattgaaacttcagaggtattgacaaaggagagctgagaaattgacactaactatcaagtacctcaggcaagaagtgatgcatcacttcctacactttcccactttccaggattcaatcacaattgcactcacgaaacctcaagggaacatgagaaacataatgaaatcaataccaagatatccaaagagtactaattttcttcaccacagaagggatattggacagacaaaaaattttgggacagaggaatatccactaaatgatccttccatgccctgctcagatgctacattttccattaaggctctcttgaccaacccataaggagatgatctccaactcctctgaacatctggaacattgcattctacttatttttactgtctcctattgtaataattgttggctattccttattagacaaattataagcttttatgggacggtgatcaaaagtcctaatttatcttgtcttcctacagcattcaaagcattgtagaccttcaatacatagcagtcttcgaagccagagtattagtattttttctaaaactgtattcatcgcaacgaactcgatggatgttcaataaaaatgtattgaatagtcattcatgcagatagcaaatttcttaaaacatttcttactcaatgtttacttatattcatcatgaatataaatttaatataataatatcaaatcccattacatttagtacaaagtaaatataccaataattttatatatgtttaagtgaatttttatatttcatattatttgtgaatgatacacatcgtcgtggaaaatttacaacgttgaagtaaattatacaatatagggtatttgtattaaaatacatttcatagaaggtgctttaaatttaaaaagttagcatgaatacatattaaatgtaaaagagtctttaaaatgaaaaatatttcacacttgtgggtttgatctaaaaatatcagtcgctatatgatatggctagacagatttgagtaggtataattttaatgaataatattgtgtgatattttagggtccaaaattgaatgtttctattaagtaacagatatttaaatgccaagcagaagctacactggcaaaacaagatttagtatgttatcttaagtgtatcctaaatcctctttcatcttatggagaagaaatacatgcttttagtttccagccactcctgtctatattcatttaaaataaactattatttatatcagatatgatgccatgtgagtccacaatttgtagtatagagaaataatttcattgaattattttggctgtttgtacctgagacctgattctgaatcatttatttttctatttaagttgtgctattttatgatcctacctatggctatgttcaaaacaatgacaaaatatattttaccctgatctttttttcattattatactttaagttctgggacacacgtgcagaacgggcaggtttgttgcataggtgtacacgttccatggtggtttgctgcacacatcaacccatcatctacattaggtatttctcctaatgctatccctcccctaaccccccatcccctgagaggccccggtgtgtgatgttccccgccctgtgtctatgtgttctcatcgttcaactcccacttatgggtgagaatatgtggtgtttggttttctgttcctgtgttagtttgctgagaatgatggtttccagcttcatccatgtccgtgcaaaggacatgaactcattcttttttatggctgcatagtattccatggtgtatatgtgccaattttctttatccagtctatcattgatgggcatttgggttggttccaagtctttgctattgtaaatagtgctgcaataaacatacgtgtgcatgtgtctttataggagaatgatttataatactttgggtatatatgcagtaatgggattgctgggtcaaatggtatttctggttctgtatccttgaggaatcgccacactgtcttccacaatggttgaactagtttacagtcccaccaacagtgtaaaagcgttcctttttctccacatcctctccagcatctgttgttgcctgacttttgaatgttcgccattctaactggtgtgagatggtatctcattgtggttttgatttgcattcctctaatgaccagtgataatgagctttttttgatatgtttgctggctgcataaatgtcttgttttgagaagtgtctgttcatatccttagcccactttctgatgggtttttttttttcttgtaaatttgtttaagttccttatagattccgggtattagccctttgtcagatgtatagattgcaaaaattttctcccaatctgtagtttgcctgttcactctcatgatagtttcttttgcagtgtagaagctctttagtttcattagatcccatttgtcaattttggcttttgttgctgttgcttttggtgttttagtcatgcagtctttccccgtacttgtgtcctgaatggtattgcctaggttttcttctagggttttgatggttttcggttttaggtttaagtctttaatgcatcttgagttgatttttgtataaggggtaaggaaggggtccagtttccgttttctgcatatgactagccagttttcccaacaccatttattaaatagggaatcctttccccgttgcttgtttttgtcaggtttgtcaaagatcagatggttgtagatgtgtggcattatttttctggcctctgttctgttccattggtctatatatctgttttgctaccagtaccagtctgttttgcttactgtagccttgtagtatagtttgaagtcaggtagcatgatgcctccagctttgttcattttacttaggattgtcttggctatacaagctcttttttggttccatctgaaatgtaaagtaatttttcctaattctgtaaagaaagtcagtggtagcctgttggggatagcattgaatctgtaaattaatttggacagtatggccattttcactccactgattcttcctaaccacgagcatgaaatgttttttccatttgtttgcgtcctttcgtattttcttgaacagtggtttgtagttctccttgaagaggtccttcacatcccttgtaagttgtattcctaggcactttattctctttgtagcaattgtgaataggagttcacccacgatttggctctctgtttgtctattcttggtgtataggaatgcttgtgatcttttcactttgattttgtattctgagacttggctgaagttgctcgtaatgttaggggcagccagagagaaaggctgggttacccacaaagggaagcccatcagactaacagtggatcactctgcagaaaccctacaagctagaagagagtgggtgccaatattcaacactcttcaataagggaattttcaacccagaatttcatatccagccaaactaagtttcataagcaaaggagaaataaaatcctttacagacaagcaaatgctgagtgattttgtcaccaccaggcctggcttacaagagctcctgaaggaatcactaaacatggaaaggaaaaaccggtaccagccactgagagaaacataccaaattgtaaagaccatcgaccctatgaagaaactgcctcaactaacaggcaaaataactaaccaacatcataattacaggatcacattcacacatgacaatattaactttaaatgtaaatgggctaaatgccccaattaaaagacacagactggcaaattggataaagagtcaggaccatcagtgtggtgtattcaggagacccatctcacatgcaaacacacacataggctcaaagcaaagggatggcggaatattttccaagcaaatggaaagcaaaaaaataaaaaattaaaaaaaataaaaaaaaaaacaggggttacaatcctagtctctgataaaacagactttaaaccaacaaagatcaagaaagacaaagaagggtattacattacataatggtaaagggagcaacgcaacaagaagaactaactattctaaatatatatgcacccaatacaggagcacccagattcgtaaagcaagttcctagagacctacaaagagacttacactcctacacagtaatagtgagagacttttatactccactgtcaatattagattaacgagacagaaaattaccctgatctttaacattccaggcaagtatgttttcagtcatacatagtacgtgaatctgttatattttaaatccaagcttttggaggacaaatgatttcacagttatacaactcagcctctcccagactcaagtctctcacttgatgcagtattcccaccccatcttcaataaaagaagaaagcatgaaacatcgcattgatatagggaaagtatatctgagttttctatatagcatataaagaagtaaaataactctgtgatttgtgatgagatagatttagctgcaacaatgaggtctggatattaatattggattaacttcctttgagattgcaacttccatgtggcattcagcactttccttgttttctcatatgtaggccgagaataaaattatcctgtttctatttcccaacatgaaaggtcttttaactgtttgaagacatatgtttcatgtgaaaccaaggaattgctactgcaattttgtaagacagaagttagcaaacttattctgtaaggaacaagatagtaaatattataggctttgcgggccatatggtctatctcacaactattaaactctgccatttttttttttttttgcaaaagcaaccatagacaatatgtaaatgaatgagtgtgattatattccaataaaactttatttttaaactacaagactagttcttaaaataaaatttaacaaagaactattatatgatccaataattccacttctgggtatatacccaaaataattgaaaacaggtattcacacagatatttgtacacccaagttcatagcagcatattttactgtagagaaaaggtagaaacaaatgtacactgtgtacactgaccaagaatggagaaacaaaacgtggtgtatccatacagcagaacagtattctgctttaaaaaggaatgaaattctgtcacatcctaaaatagggatgaactttggagatattccacctagagtagttaaattcttagacaaatagttgcatggttgccagggaccagggaggggtaggggaaatgagcagttcttgtgtcattggtatagagtttcagtttagaaagatgaagagttttggagatagatggtggtgatgtttacatatccatgtgaatgtatctaatgccactgaactgtatacacttacaatggttgaaatattttgtatattttcccacagttaaaaaagacaagcccatgtgcccaaattgctgatataaatctgtattcctattagtgagcagtaatgagccatgtttagtgcagctgatatggttaagatggaacaattgcatgtaatgcaatggtgggtaacatctaataaaaattggtactcaccaatttccatttccattgtggatataaacacccttcacattatgaatcatgttatttgttatttgtgtacttacttattaaatcacttttctccatctctctcacctctatgactctgtacatgtacaaacaacatacacactgtgaacttctttagaatgacagttacattttcgttacttgattcattgtttggccaagtagatacccagtaagcataactagcaagtgaataatgtatatgtgatcattttccttttcaaaaaccacttcttatctctaccacaccaccacacattattatatgctacacttcttatataaaacaaaaaagaataggccaggtgtggtggctctcgcctgtaatcccagcaatttgagaggccgaggtgggcagatcacttgaggccaggagttagagtccagcccagccaacatggtgaaaccccatctctgctaaaaatacaaaaattggccaggcgtgttggcgcatgcttgtaatcccagctacttgggaggctgaggcaggagaatcactggaacccaggaggcggaggttgcagtgagctaagatcatgccactgccctccagcctgggcaacagagcaagactctgtctcaaaaacaaacaaagaataaataagctttaataaactcttttgcagaagagttttcatttttaaacatagaggaaaaagaagatgaggatgaacgatagtgatgcccagaagagaaaattgtgtaagacaaaatcaattgaccaggcgtggtggctcacgcctgtaatcgcagcactttgggaggctgagacgggcagattatgaggtcaggagttcgaaaacagcctagccaatatggtgaaaccctgtctctactaaaaatacaaaaattagccgggcttggtggtgcacgcctatagtcccagctacttgggaggctgaggcagaagaatctcctgaacccagcaggcggaggttgcagtgagccaagatcacgccactgcactccagcctgggtgacagagcgagactacatctcaaaaaaaaaaaaaaaagattaaatcaattttagattgatatagagataaataattccctaagtacaattaaagcaaggatcagaccctgatgagtaaggatgatctaacaaagggctgacaatataaagtgaatgcgattgtcaccaaataaacatctcccaagagctttgggacaatcttcagctaagcatattctgcactttacatcgttctgccatatgccctatgtagcttttcatcctccagaaatttgaatagcacacagtattttttggcaccgagtaattgtggaacttaaacttcctacaaagagagaagctgtttcagtcagctaagtgaccagttagtaagcaacttctattctcttagtgtcgatagggttaaagacagtcataagctccccaaacccttggccgcctcaattttttcatttaaatacttatcttcttatcttcatctattttttagagtcacacataaactctgtctatgaggttcttaaagacctggacaatatatttaatctctgtatccttaaatctcaccatgatatctcaaagatggtagataaaactgttttccctcacttctctgactccataccaatacttaatcgatcgggaaagttttataaaccatttaccgttgaatataaatatatatacacacacaaacatatatatatttatatatatttatgtatatatatatttatatatctatatatatttatgtatatatttatatatatttatatatatttttatatatttatatatttatatatatttatatatttatatatatttatatatatttatatacttatatatatttatatatatatttatatatatttatatatatttatatatatttatatatttatatatatttatatatatatttatatatttatatatatttatatatttatatatatttatatatatatttatatatttatatatatatatttatatatttgtatttatatatatttatatatacacatatttatatatttatttatatatgtttatatatatatatatatggcactatatatcagtgagcaaaggcatcataatctttatttttatttctgtattcatttattcaacatatagtaattctgatcctgtctcaaaaactctacagaaattaacaaagaacacattgtttctgcctttttggagctgaatgtttagtgggggaaaatgtattttaaggcaataatcatatacatgagtgtatatttacaagccgcagtaggtgctatgaatgaaaagtataaggagctatgagatattctaacaaaaagaaatgctgcagtctagagactgagagtaattatctgtgaggaaaagtattgaagcagagacctgcaactcagtaaagagtgtagggagtcacatgaacaaagtcttgagatgttggtagagatcttggaatgttcgaaattctaaaagaaagcccttgtgtatggggtatggtgagagagggagagcgtggcaagttttacgttgtacaagtcattgtaggccacaaaaataagtatagattttatctaagtgcaacggaaaaccattacaagtttattttttgattcttaaattttgttttacttatttatttatttcaagacacaatctcactctgttgcccaggctggagtgcagtgacatgatcacggctcactgcagccttgaactccttgggctcaagcaatcctcccatatcaccctcctacctcagcttcctgggtagctgggactactacaggcatttgccactatgcctggctaactttaaacaattattttgaagagacagggtcttgttacgtttctaagtttctaaggctgatcttggattactgggcccaagcaatcctcccgcctcatcctcttaaaatggtgggattacagatatgagccacctcacccagcaaggtagtgacataatcattgtttttgctgaaaacaatgtactttagggaacctccctgaaaacagaatggccacttagaataccaaagcatagaccaagccttgagatggcaatggaagtggaaataaacatgtctttgatacttatgttaatggagctattagtagcaacttttgacagatttgaaagtggagttgaaagacagtgaagtgtcagggatgatccctgagcatattagataatattgagctggagaacagaaaagaaggggcagatttggaggtggagacctttctagatttatattcaatttgagatacatctgaaacatctacatgaaacgtggatgaaatatctgtgaccaagatacatacgtgggatacctaggcatgtaaataatatttaaagttatgtgagtgggtgcaataacctaaagagagactgtaggtagaagattgatcaggacaaatctttgaggaacttttttttttaattattattatactttacgttctgggatacaggtgcagaacgtgcaggtttgttacataggtatacacgtgctatggtggtttgctgcacccatcaacccgtcatctacattaggtatttctcctaatgctatccctaccctagccccccacccccaacaggcaccagtgtgtgttgttcccctccctgtgtccatgtgttctcactgttccactcccacttacgagtgagtccatgcagtgtttcattttctgttcctgtgttagtttgctaagaatgatggtttccagcttcatccatgtccctgcaaaggacatgaagtcatcctgttttatgaggtacttttaatgcatttagtgactgggtaaggaataaccctgaaaaggagcacaaaaaccatcgaggtatgaagaaagccaggagatgtagtttcacaaagcagccagtggacagtaatggacaccagcataagcttaagacagcagtgatagtgttcatcagtgctgaaaactcattggaagtggctgaccatatgttgattgcgaatgcaatgccttctcccatctcctattgcttttcactgtttccgtcatgtccagagtgaaaacactggggaggcagaactgtgtaccaagaaaaatgttttgtgtcagaggaaacaagagctcattaatttccttttgacccgcatggataggaatacgataagcaggagaaaaataaaacctgctaaactaggcaaataaagcttaatagaaaagagagaaaatattgcttacaaagggaagaagacatttgccacaatattagctaaaaagagagtgaggaaaatccacatttaccatttttattatgtgtttccaaagtcgacattaagtgaatattatcactttgaagacagagaatagattgtaagcagaagaggaagtgggattttttaaatggcatatatttaaatgttgaaaaacccatttccaatactcccactgagatatatgcaataaaaacactccgcaatcagtaatatacatgtgaagctcctaaaaatcctccattgagaagattctataaaactataaagtattattatttctgctatcagaaaataaacacatactttctaagaacaagatgaagaccttaattcatcttcccaggaatatacttgtgtacttaatggttcaaggcgtttgtgatgcaaaaaaagtgggacattatgtacaaaatagttttaatcagaaaatgaaggaagtttggtatggtatggttctagggttgcaagttttcctgcaaaaagggagtacttatggctaggtgatgcagccaaggaagcatctctgaggacaggttatcctggctcctattccaaaatatttaggtctccttgagtgttcgatccttgaaccaaggacaagaatagaaagaaataaaagccacttgtataaaggttgccttcattttgtgtcgaatattgacaggagaaagccagatttgtagcttttccagggataagtgagtctcagacacagttaagagcttggctttggaattagattgacctgagtttgaatcgtggctccatcaatctctgattgtgtgaatttttggcaagttttagctgaacctcaattttctcataagtaaaataggcataatacagctatgattctgacccttgccattagcactctgagctacttgtcagtgtatcctggtctcttcctcaagcacttttccactttgttatttcaagattctttgaaattatgaacagtagctcttgatcaccaaacaaatgggagaccatagattcaaaggaacattttagtaggatatttgataagctttgtatttttttgtgctttgaaaattagagtagatttagatttaaggaactataaagctatatgtttacaaaactttattcagttgggcagttctgactcagtaactgaaataaaattgatgaaaacaaaacatatgttttactgttgtgttcacatttaaagattatttaatgcataaccaaaataggttcagcaaatgtttatacatacatgtacttagatatttgtaattcttatggtagagcatgggaatgaatgagaattctcctaggctggaataaaactaatgtctaactaagaattggcctttcacttcacgaatatatatcattatatataaaagattcatcctttgttaacttatttgtttagcttagtactttctaagtacttttctatcctgtcttggtccctatataagaatgatactattataaaaatgaacatcctattatttcataatgattagcatatcagcatatttaagagcaatgcctatatctttaccttcattattattttcatgtttaaaatcctgataattctagaaaaacaaggttgtaattatccattcataataaaagtcacaccaagttattcttgataattaacttggcatagtggagtgcactgagcaattaataattaattacgtggttactagctcaaattttattgagaaccaaggagttaaaattaatagtattgtgtttgcaatgagttaattactttgtttctttgtttttttttttggaatagtgccataattagtatcctaatagaaacagaatataaagtgggtttctgagtgcttgcttgtcgaggtgtgtaacaacatatattttaattataatttgagtcactaattgttgtcaaatacaattttaatttcttagttcagagattaaaagatatgtaaacagctccaaaaaagaatatgataagatggtttatacaagtaaataaataactatatgacttcagaagttttatttaacaacagttgtataagtgttttaactaatgttaacaatgccttttttgtaaatctcctctaccacaaatatgagataaatttaagaacggcattttcattaaatattgattattaaaattcatatataagtattggctgtacctgagcatttacagtgaaaccatgaaggactggcaggtttggggctgtttgataatatccttccttaatctttcttcgtagcatcattgtttaattttggctgaccacaatcacttatgaaaagaaacagctcaaataattagtataacctctttctcttcataaaaccttcaaatcaatgtggtcataattatgaaagtgtaagattataaaatcttctcatttaaatatacatcttcatattagcagacttggctaatttcttcatttatccttgacatccacacttaaactctgtcaaactggtcattcatagactcattattcattcaacaaagattagtgtgaccctactatgattctgagggctagaaatataaaactgaataacatataaaccctgatttctgtatttatatatacagaaaggaattatgaactcacagttttaatgcacagtgacgagtcctcagttcatgtctgccttgggagctaggcatataccaaagcaggactgtctaacacagtttgggggtctcagtctggaaggatccgggtgagatgatccttgaattgagttctaaaaaatgaggagaaattatccagataatggaaagtttaggagaaattaaccagataatggaaagtttaggaaagaaacactatttatatgtcaaggacaaagtttgaccaaatgtgtctctgaatctaactggctttatgtaagataaaattaaaaaataattgtcactaaggtttttcacatctgcagcaactaccatcatatctggctcaatatttaaaagaaatacttaacgatttttggcatttattgctactataatagattgtgctatttaaagagaaattctagatacatgccaaagtattttcaggtgaagtaatgtgattcgtgggttttgttttgacaaacttccaaggaaattatttttaatataaagagcaatggaggaagattaaacaagattcgcaaatgttgataattgctcaaggtggtgacaggtgcatgggggtccataatatactgttctctttacttatatatgtctttgaagattttcatgatgtaaaattttaaaatcagaattacagtaatacctctttctttgacaatcgttttcaaacttggttcaacaactgaatttaaattacctacatggctataaaaataaattagatatcctggttatttggtctggggtgggtcctggccatatctgtagggtgtgtgggtgtgtgtgcatttagcttcacatttgactctgaagtacgtggaaaaccaattctgggctctacatatgcaattccaatgcctgacattaggtggtgctggttgtgagccatgatttcaggtttgacttgtagagttaacagaagtgatatcaccaccgatcccacagaaatacaaactaccgtcagagaatactacaaacacctctacacaaataaactagaaaatctagaagaaatggatacattcctcgacacatacactctcccaagactaaaccaggaagaagttgaatctctgaatagaccaataacaggagctgaaattgtggcaataatcaatagcttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcattctgataccaaagccgggcagagacacaaccaaaaaagagaattttagaccaatatccttgatgaacattgatgcaaaaatcctcaataaaatactggcataccgaatccagcagcacatcaaaaagcttatccaccatgatcaagtgggcttcatccttgggatgcaaggctggttcaatatacgcaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggacatatctcaaaataataagagctatctatgacaaacccacagccaatatcatactgaatgggcaaaaactggaagcattccctttgaaaactggcacaagacagggatgccctctctcaccgctcctattcaacatagtgttggaagttctggccagggcaatcaggcaggagaaggaaataaaaggtattcagttaggaaaagaggaagtcaaattgtccctgtttgcagacgacatgattgtttatctagaaaaccccatcgtctcagcccaaaatctccttaagctgataagcaacttcagcaaagtctcaggatacaaaatcaatgtacagaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatatcgtgaaaatggccatactgcccaaggtgatttacagattcaatgccatccccatcaagctaccaatgcctttcttcacagaattggaaaaaactactttaaagttcatatggaaccaaaaaagagcccgcatcgccaagtcaatcctaagccaaaagaacaaagctggaggcatcacactagctgacttcaaactatactacaaggctacagtaaccaaaacagcatggtactggtaccaaaacagagatatagatcaatggaacagaacagagccctcagaaataacgccacatacctacaactatctgatctttgacaaacctgaggaaaacaagcaatggggaaaggattccctatttaataaatggtgctgggaagactggctagccatatgtagaaagctgaaactggatcccttccttacaccttatacaaaaatcaattcaagatggattaaagatttaaacattagacctaaaaccataaaaaccctagaagaaaacctaggcattaccattcaggacataggcatgggcaaggacttcatgtccaaaacaccaaaagcaatggcaacaaaagccaaaattgacaaatgggatctaattaaactaaagagcttctgcacagcaaaagaaactaccatcagagtgaacagggaacctacaacatgggagaaaattttcgcaacctactcatctgacaaagggctaatatccagaatctacaatgaactcaaacaaatttacaagaaaaaaacaaacaaccccatcaaaaagtgagcgaaggacatgaacagacacttctcaaaagaagacatttatgcagccaaaaaacacatgaaaaaatcctcaccatcactggccatcagagtaatgcaaatcaaaaccactatgagatatcatctcacaccagttagaatggcaatcattcaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcagcactattcacaataacaaagacttggaaccaacccaaatgtccaacaatgatagactggattaagaaaatgtggcacatatacaccatggaatactatgcagccagaaaaaatgatgagttcatgtcctttgtagggacatggatgaaactggaaaccgtcattctcagtaaactatcgcaagaacaaaaaaccaaacactgcatattctcactcataggtggggtgggaattgaacaatgagatcacatggacacaggaaggggaatatcacactctggggactgtggtggggtggggggaggggggagggatagcattgggagatatacctaatgctagatgacgagttagtgggtgcagcgcaccagcatggcacatgtatacatatgtaactaacctacacaatgtgcacatgtaccctaaaacttaaagtataataaaaaaaaaaaagttcgttcctcttgttagaattttcatacaaatgcaagactccttattttcaaagagaaaacaaaattttatataaactaatacctgagaagaataggaaaaattaatgatgtatgggataggtactgataagaacctcttcttttgtgtacattgtgataaactaatgtttaacttgagtcgatgtgctggaaatacttgttaaattttcaagaattttgagatctgttaaacacaaccattatcaaaaattaaattatggtaacttacattaaatgaaatatattgttcacaaatgtactagatgcacaaaagtcatcactacctaattcttttattatatttcactattatctacgggtttgttacctgtataatggaatgactgtataatggtgtagtgctaacttcatgtttggtgacattataatgatagcttaaaattaaacatactgggaatattcaaatatgtccttcctctcaggggatctgattgttagacatttaccagcatagcactgtcttaattaacatcatataattgtcttttatccttaagatgttgagccagtaaatatcacaggagagtttgttccttaggttttaatacttgctttaccagtttactgtagcatcatgtgaaaccagcttctagaccagctgtctttaattggtatgtacccaagctaatccttgtcaggctatcatcaacccaagcacttttgaagttatttttattattacgctacagaaagattttatggcctttttgctcttttctttaccctagccctaggatcatataatttcatctcctatttattcctatttatttccttatctaaaatcttacttaactagcttgcttgcctgcctgtctgcctgtctgcctgcttgcttggtttttctttttttctttcttttctttacttctgctttcctttcctttcttttgtttcttccttccttccttccttcttcctttcctttccttctgttccttttccttttccttttcctttgcgttcctttgctttccttgctttcttcgcttgctttcttttcagtaccacaaaaaaactaacaataacaaaaatattgctacaaaaattgtgacctcccaattctatcctcatttcacggacccataaaatgattatatatctatgccaatgcgttctaactacatgatattattattgatgataagagaatccaaccctcaagaaatgaagtattataatgttttagaacacacagaagcatttttaaccaaaatgttccatgtgattttatagggtgcatgttttaccttttcttatttggaaaagtagcaaaagtattaacaaataaaataagttacatactctttgtatataaatctttcgtgtacataataatgccatttcccttctagtgcttccattattgaaaaaaaatagacatatagcaacgtgctagacattgaagttaactgttaaaaagtcatcagagggtaatgttaaaggtggtatttcaggtaataaagcatatgcagaatgattctattggctttatttccaacatgagtgttattagtaccaaggacactgaagtttaaaggaggggagtgatgagactgatcattactttgtcttctgtaacaggacttaggtggcccagagtgatccttgttggttgattggttagttgaacttctatttttgttactaggcctgcagatctgtggaatctccagagtgctgtgtaatgttacataggccacacaccagacactgttccctgaaggactgaaggtggaattggaacaatatgtagacagttcttgttgcagttaccaaggaaatttggttaggattcaggcctccatgtcagaaaaggaagtctattttatgtgctagaaaaataaccctaatcatcttatcttgggtctctctggggagcatgatgatctacctggtcttgtaaactgtatagaaccggctgggttgagacacatatgtctcataacagagcttccacttaaggctataaaatagtggtccctctattgggtatatgccttatggaaaaatatacgttatgctggtacctattataaaaaccaatgcaaaatgattagagatttctaatccaagtgttatcctcatctgctcccaaaatacagcaatgaaaaaatagaaaataaaaaaggatatatttacagaactgtatttacagaaatatatgttgatgacaagataatcaaatacatatcaaatcatgatgtgtatttacagaaatatatttacagaaatgtaaagcagagaatggggcggaagtccctgacagacttgacactgaaccacaaaacaacagtggaagccaggaatttggatgctgcgggatagttgggattaaaattgcttcaagcaaggtgtggaactggagacaaactcagtattcaaaaccagaggctgggctgtggtgcttgcattcgtgaaagaaaacctggggaaaaagtgcttcttcaggctgtagcctgacgctatggcttgcctaaacttatgggcctatgtaggtgtaagaataaagacatagccttgctgctgggaactgtgttgcatctgttctcttgcttgatgaatggattgaaattatccccagtaacattgcagtgcaagaactttaaaccttaaaggggtggctggagaccacgggacgcgatgcacatgcaactactaaatgctagatgaggatacctgaggagagagaacaagacacaaacgtgaacatggacctccaatagaaatgacaatcgaaaacatacatttatcttctctctctcccaaattgttcaaagattacgctaagggaataaaaacaatacagtcataaaatgacaaataaaatggaagaagagacatctgcacagacatatcaagtcaatgagatgaaaattaggacaagtaagccaatttgtttttcaggatcccagaaaaacttgtggattgaagacgctaggtgttttagaaggccatatattcccgagaggggctggaaataaaggggttgttttgaatcccttaaaaggggcaattacatttcatgtccccagctcagggtagttaattagacactactcctctctcatcccagcagacgtgagtgagtggtttgctttctggtgaggctgaaacaacttttggcatttggacaacaggattagttgatggaagagagagccaccatactgaaaatacaggattaagttaaagtcaacatatttaatggtgagaccagcagtccctcttcaccttcttggctcttaagtttctatcctctgggcagtagattataaatttattctcctgagagcctacctgcaatacgaaaactatttttagtcaagttttattgctataacaaaataccatagactggatgccttataaacaacagacctttatttctcaccgttctggaggctgggaagttcaagatcaaggcactggcaggtttggtgtctggtgaaagctcatttcctgtcttctcactgtaacctcacaaggcagcaggtccaagggaactgtcttgggcctcttttgtaagggtactattctcattctggatggctttggccttatgacctaattaccttccaaaggccccacttcctaatgtcatcaccttgagggtgaggatttcaacgtataaattttgcaagaacacactcagatcatagtaacctacaattaatgatatgtaatgatccaccagtgaaatagccagatctgtgcctaatgaccatatattgaagcccaccaagtataagccctacatacgcacaaggaatttccaaaagcatttaatgcctcagttttaagagacaatcaaggatttccagatatttgaacatgtctcaaagatggaagacagaaaccaacataaaaacaaaaagcagaaatattgggaaaaaaacaatagccacataaatgaaacagaaatctctgcagaaagagagacaaggcatagaccttaagaaaactttttaaagatagctataaaattattatctcacagtgagactagtcactgtattcataagaaagaacaagagactatagaaggtggtatttccgagaaagataagggttatttaaattaatagtatagcaggttaagtttttaaattcttaattgtataaatttatgggttaccagtgtaattttgttatatgaatatattttatagtggtgaaggcagagcttttagtatatccaccactggaataacatacatggtatgcatagcagttttagagcaatgaaactactctgtgtgatactataatggtggatacctttcattatatatttgtccaaacccatagaagatacaacatcacaagcaaactctaatgtaaactatggacttcgagtgttaatgatatatcaatgtatgtaagtcagttataacaaatgtaccactctggtgtgggatgttgatagcggggtaggctgtgtgtaatgaggaagggggccagagagtatacgggaaatctctgtactttcccctcgattttgctataaatgtaaaattgctttaaaaaatcaagtctattaaaaatgaagagcagaaataaaagttcaaaagtagaagataaatttgaagaaatatctcataaagcagtataaatagccaaaagcatggaaaatgggagagtataagaatcttagaagatcattctaggtaagtgtttcacaaatagaggtgattttgtcctgcagaggacgtttgacaatgtacggagacctttttcgttgtcacaaataaggaaaggatgtactactggcctcttgtgaagagtgacgcaagaggaatgcaccatgcagccatccacaaccaagaattactcatttcaaagtgtcaatagtgtttatgtttagaaaccttgttctatgtaatccaacattcaaataatagatgttaaaaataaaacagaagagaggcaactgtggagagaaaattatcaaagaagtgacaacatcagttttcttagaactgaagaaaatgagtgtccaggtttaaagggcttactaaatgcccagcacagcaaatgagctaaaaatctacaccaaggctcatcatcataaatttttacaaaaacaaggacaaagagaagttcacagatcagaaatcagaatggctttggacttttcagcaatagccatggaaaatagcagaaaggaacacttcctttaaacttctaggaataattaactttggctttgatttcatatcctatatgaaattatgttcacaaattctgtgatgctcttctattcaagagttacagctaaatgtccctgtcattgagtgtggactagattcagtgactcttttgtgatgatatgtcatttccaagtgtaggttgtagaaagactgtggtttatgtcttgtgttctccatccacgcctatctctctctgtgtctctctttctctctctctctctctctctctctctctcatgcattgcttcttctgtgggaacacatgtcatgagcagccctatggagatgcacgtatgctgagaaactaaggcctcctgcaaagagccacaagaatgagcttagaagtgcatcatttaacaccagacaaatctcgagaggctgcaagcatagacaacagcttaactacaacctcataaaataagctatgccagtcccaccctgctaagccactctcagattcttgaccttcagaaactgccaaataataaacatttttgtttttaagctgctaaattttggaatgacttgttattcaacaatatataaattgtacaccctgataaactataaattgtgcggagaaaataattttcagagatagccttatgtactcccctaaaccttttttccccagaaatctattttcaaaaatatactctaccaagtgaagaaagaaaccaagaaagacaaagaatgtttagttgtgattggagatcagaaggagagtgttttaggcatgattcgccttgttatgctgcaataataagcaattccaaaatattagtggctagaaacacaaaggttgattttgtatctttgcaacatatccaacacaagtcagtcaagggttctgatcattgtagtcactcaggaatctaagctgattcagtctctagtattctatcattctaccgtaacaataagaagctttagcgttcaccatgtcagtcaaaaatgcgtggaaaattttaaactgactcttacatgcctctatgtaggagtgatatatgtcattttcatttcacttcatcatccaaaggaagtcacgtggtcatgcctaactctgaggggacaggggattataatcactaatatttttaagagaggtaagagaattaggaaaatattggagcattagtattacctgcaaagcctaggatccggaaaacagagaacccaacgtgggaggaagatgcaaagtggtgccagaaagatggtggaggagatcctgtaacaacagctgtataacagttgtagagagaaacctgtacagattggagaagaaaatagtgctccaggaattttgttaccaagaaaaaaaaaatctaatgtattcgaatgtattgagaggtggtattcttattgtgtaagagtataatatatgacatgtatgacagacagaagtaccatttaaaattttattaaacataagaattagatccctatctcacactgtacataaacataaaaatggtaaattgatggattgcctaaacatgaaaggcaaagcattaaaatatataaaaatattttggggcatgtagggcaaaagaggtgtcccttaagcaacagcacaaagcaaaaattgtaaagaaaaagacatatatttgatcattttaattaaaaacctgtacaatgcaaagacttcataaacaaagaaaagacataggctcagatagtatatttgcaatactaaaacaataaaggatttatgtcataatttaagaaaaatatttacctatcaatagaacaaaataaaaataacctaacaggaaaatatttttaaagtttaaaaaataatagacagttcacagaacatctgtatgtcaaatacacttatgaatagatgctaactctcatttattattggaaaaattacttcatattagtcggttttcatgctgctgataaagacatacatgagactgggtcatttatacaggaaaaaggatttaatggacttacagttccacacagctggggaggcctcacaatcttggcagaaggcaaggaggagcaagtcacatcttacatgaatggcagaaggcaaagaaagtcccctttataaaaccatcagatctcatgagactaatttactatcacgagaacagcatgggaaggacctgcccccatgattcaattacctcccacgaggtccttcccacaacatgtaggaattcaagatgagatttgggtggggacactgccaaaccatatcgtactaagtgagataacgtactcccatcggactggaacaagtaaaaaataaaataagattgtgaaaggtcacaaactctcattcttgtagaaatttaagttggtacaaccaatttagagtgtaatttagcaataatctagttaaactgaggatggcatgtcctaccaaacagcattccagttaatcacattgaagatagcatgattgttctcaggcttccatattttctgttgaacggtaagttgtcagtctaattggcattcctttaaaatagacttgtttcctcttgatgattttcacattgtaattttgtctgattttcagcacttcaccggtctttaaatgattatgtaagattttcattgctgaggaggaaatcctatcacctcaaatactatcttattagttatattttcattttattttaccatgattttaaatgaattccttaaaaaattaggttagagaactaataaatgataaagagaaaaattattcttcatcctgatagctgttatgtgagggtggaatggtatggctggtttttttcactgtcattttgtaacttggaaattcttattttttaatacaatgacaatattttcatagttaaaaaacactaaaactaaaacaatagtctgttaatgacaaatttaagggcgatttcattaagttaaaaatccatgttaaggcattataagatgaataaatactccaaatgaaaacaaagtgaaggccacttttatttaccttttgtacatgatacttatttttcaacagttgtcatgttagaaaaagttgaaaaaataaaacaagatacacccccttttggcctctaaccttccaaaattgtaatgggtagacttcaaattaaatatctaattcgactcctttccacttctaccctcatagcattagagacatttggaaaaatgaaaaaaatatagtattttatggcagggtacctcaaccccagagccacagacccgtaccaatccgttgcctgttagggacccgattcgcaaagcagtaggtgagcagcagcgggctagggaaggaagcttcatctgtatttacagctgctcctcatcactccatttctgcctgagctccacctcctgtcagatcagcagccacattaaattcccataggagcacaaaccctattgtgaactactcatgcaagggatctaggttgcatgctccttatgagaatctaatgctgcatgatctgtcactgtctcccatcaccccccagatgggaccatctagctgcaggaaaggaagctcaaggctcccactgaatctacattatggtgagttgtataattatttcattatatattataatgtgataataatataaataatgtgtgcaataactgtaatgcacttgaatcatatggaaaccatcctccaacccggtccacggaaaaattgtcttccacaaaatcagttcctggtgccaaaagggtcagggaccactgttttatgggataagtgaaagctggatttgaatccaactctaccttttacttcccatgtgaacattaaaagatgacttaatgtctctgaatctttttttccttctaagtaataactaccttgcagagttattacttgaattggccataaggtaaagaggacaccaaatacagtaaataataacataataataaagaaaccttatgaattctattcagtgatatccatattgaggtatttaaggtgaatgatactgatgtcagcagtttacctggatatgcatcaaaaatatgattgattgatggatggatcggaggaaggaaaagatatgtgatcaaaacgagtatagtaaaatgttcatggtggaatctagatatatagatatcacttgtaatttttaaaaatgttattgcatttttgaaatttgttatgttaaaatattgggtgaaaattctgatgccctggccatgtcccaaatcagttgaatcagatctctggtgtattttttttttaagatccttggatgactccattgtacagcaagtttgcaaaccactattctaacttctcaccacccccttctttatagcttacaaaattatatttttaaatgtcaaatgtcacaatttcactttccttcttcaagaactgattagacttctagcttctcctatgctctcatcttgcataacgttcatttgcacgtggttaaaactgataggcaataaataataacccatctgtcttttcctgacccaacataactaaaaccttcctttcaaggcgaaaatgaactataatctcacagacaagagtagctatagacaactaattctttctggtctctcgtggtcatgggactattcaccactgccgtccctgctgtctatttggtggaccagccagttttactgtgacccataccatggctcttgagaagcatgaagctgccgaaatcgcagttgtagggttaatggaaaacatggtgaagtatagcttacatatatatacaattttggcacaaaatgaagcctaagaaattgtaccgggctgggtgtggtgactcatgcctgtaatcccagcactttgagagaccaaggtgggcggatcacctgaggtcgggagttcgagaccagactgagcaacatggagaaaccctctctacttaaaatacaaaattagccaggcatggtggcgcatgcctgtaaccccagctactcaggaggctaaggcaagagaatctcttccaccctggaggcataggttgtggtgagagaagatcacaccattgcactccagctggggcaacaagagcgaagctccgtctcaataaataaataaataaataaataaataaataaataaataaataaataaaagaaaaagaaattgtaccaggaagtggattgggaatgctctatatattctccccctccaagaagtttttttaatttattgtattgtgaaagatctgcagctatttattttgtgtggtactcttttgcaataaactacttctgcataaatgaactcaaaaactttgatattcatgaaccttcataatgttgatctagtacatcttgcccaactagcccttgggccattccttccatgccactggttgaaaaatatgctccccaccccagtaacatcagcatcagacctctgcaaccagaaagattccataggtaatgaaatccaaatgctggcatttggaagtcaaaccagtgtattttgaaatggaaaggcaaggggaagtgcatggagcaagtacagcatgtgctacaacttcagttcataccctccttaaaatactgtgcaactaaactgtcaattgcccattgatagagatagtatctttttcagctttacaccttccgaattcaacacactgctagcctcaggactaagcgctcaataaatgtttatcaaaagattgagtaaatgaatcagtggtgaaataaaatgtacaaacacatacgcttcatacacgtttaggaagcatttctagtgagctttgtggatattttatttcttaaaggttctttttctttccatgttcatgttattctttattttttaaaatgttgcttctgcttatttctctttctacggcagctatatttacttgcctgagagcacagcatatactgatgttaatcaaactttagatgaaacacctaaaatgatagaaaagaatctgctctaattaaataataaagcaacccctacaggtttagacatgtgccttccggtgtgggaaagaaaaaatttaatgaatgtagtagttttatgccaagaacatttccctcgtgcacctgtgttttaataagatagaatataaaatagcaaaaggggcccgacttttgtgatgatatttactcataaggtagtaagtcagatgtgatgacattttctttgacttagagctgctatacttgggtcagatttcagttcagtaaatttgcagtgaagttgtctttctaacatggtgtcatcctggaactgccctgctcccacagttacatacaggctagggagtgggtaggagtgggggtgaaatcctcttaatgtttatggtgtcagtagattcaaactaaaattagccttacagccatactcctaataaggggcccctggcatatttaattgatttaacaaatttatcaaaaatagataaactgaaatctgccttgaaattaattactgtatctctatttttataagaaaatattttggacccgttccctctgccttatgggtgcaactcccggcagaataggtcatgtctcctgaaaatagttcttattttctttactacttatgacctcttatagcctagaagtttttccttgctatttctagttgaaatgctaatctggcataatttctagttgaaatgctaatctggcataatttcagaactaattttctgttaatgccacttggaacatctaaattcctcctttttcaataatactatatttgtgtgttgcaaacacacacaaatcatactatatttgtgtgtatatatagtaaattccaacttataaaagtaaaattggaatttttttctttctttggaaaattattttataattgagaattataaatgtcacttttttaaatgctgcaacctttgagattggtttcaataaagtaaaacttagtaaacattaagaaaaatgatagcttgatatgttcactaatatggtaaatgaaaacttttatgtgtgtataggctcttgttaattataactaccttcacaggaaaaacagtcttgtggaaggtaatggtgccagtgagagaaaatagagaaagtagaatagtagtaagagagaaaatagaatttcccgtttagaataaagctaagtaaaaagtgaattgtttcagttttatttatgtatttgtaagtgtggtctcatgccatatatattcaaagatagacagagatcttaatctttaattttttatggccaaagaaaatgagtcccatgtaaaagggacattttcgtaagctgatctcaagtggtgtattttgatttgccgcagcagcctatggaagaaatatcattttggctgcctaagaagaaaaatgtcatacctttctattttttattcatactccgcatatttggaattcgtattctcaccatacttttgggaagataacacgaaattgccttacttgcctcgaaatcaaaatctgccattcgttttaaaataaaatggctttttcatctcattttcctttagcagaaaaaagtaagttaaatttttttgtagctgtgttaagtgtactgttcctccctcgttgagaacgaaacaaagacatatgattccatttactgtaattgttttggtttgcccaattacaatagcagtaaaatcatttacacatagtaaaatgtttgagccttaaagggcaagaagactaaatttagctgaagatatacaactttcatgtgccaatgaggaaatgtataaaatcagttatacatattttcctcattcatagatattgaaaatattcatatatgtgtacatgtatttgataacttaatattttctaaataacagaaattatatactgtatatatatttggatattatgattattgttattgccaccattgagcacttactatgggctcagaaaacttcactgtattatttttaattcttataacaaccctgtgaaatatatattatgcctatttcacaaatgagaactctgaaatcaggaaattaaatcacttgctgaagtttacaaagcactgttaggcaataaaacagaatttcaaactcacgtttgcttgtcttcaaattttgtatgctgtacaacctgattgttttactacttgttcttaatttcaaaaaaaatcttcatactaaaagatgatactttgggagttctaaagaacatgtttttggccgggcgcggtggctcacgcctgtaatcccagcactttgggaggccgaggcagaaggatcacgaggtcaggagatcgagaccgtcctggccaacaaggtgaaaccccgtctctactaaaaaatacaaaaaattagccgggcgtggtggcgggcgcctgtagtcccagctactcgggaagctgaggcgggagaaaggcgtgaacctgggaggcagagcttgtagtgagccgagatcgcgccgctgcactccagcctggttgacagagcgagactccgtctcaaaaataacaaaacaaaacaaaacaaaacaaaaaaaaccatgtttcttttcagaaggtatactcatttgaagtggataccaattatttgtattaaaattacttatggataaatttgaatctgcaaaaattaagtgcaacattattttttggcacctgttataggaggtaaaaatggtgattcaatatagtttctacccttagggagcatttagtgtggtttagacgtaatgacactaatgtaaattagagtagaataaattctttaaagcaggacaaaaggagtgttaaagactacaaagtttcagttatggaagataaaattctggagatctattatacagcatagtgcctatagctaataatgctgtttcggacacttaaaatttcctaagaaatcttatgttgtgttcttaccaccagtaacaacaataataaaggggacaagaggaaattttgagtgatgacagatatgtttatagccttcatggtggcgatggttttgtgggtgtatacttattcccaaactctttgattttatatatatatatatatatatatatatatatatatatatatatatgatgaaactctttgagatatatatatatatatgtaaaatatgtacagctttttgtatgtcaatcatacttcattaaggtggttacaaaaaagaatcaagaaaaataatcaccctaataaaaagagtgttattaaagaggggagggattacttctaattggtagtatcagaaaggttctcatggaggaaggtatagaaaaatttaggacaatataagcaacgatactttaagaaaaggaataatataaacaaaaataaaccaaaagatgaagaaccaccaaggatgtttctgaaaaatcaagagaaattccattttgatttgagagtatgaggtacttgtcatgatatataatgagaagtgtctagaaatatgttattttgagcaaatgctgcttagaaaggaggttaggttatttattaatccattcctttgaaatataaatttcatgatcagaaacacgtgagtgtaactatccaataacaacatgatttatttccaagaggatagtatattataggagaagtaggattttttctctttcacaagctaatacagtgtttactgattcaaatgacacttaaaaaaaacaagaaacaaaaaacatacactataagctatccttattcagctatgttattgtcttgcattcctgattagaaacatacaagttagactcccaaagtctcagttttctcatttgcaaaatgaataaaatgatagtacctaccccaaggtgctgtggagtatatttaatcatgtacttaatctgaagttttaattagagtgcatagcatatatttgtggttgcttttgctcctatttctgggtaaaagttcctacacctattatatatgttttgtgtttgaatgaagagaaaggcatcattatttcaaatatcccctctagccaacaaatgaaagctaagacttggaagctaggatgtctaacaccatatcctcttcatgtggactatatagtagaggatatgtaaattaagactcaattaaatgctcacattttataaaggagacccttgaatatatcaaatcctcagagagtatgtcagtttaaacttattaagaaatttaaattatttaacttagcctgctgagtcagtttctgtagctgatttctccaaaaggtcttggtattaaaagtagcattacagatcactaatagcaaactatttctgctactttgggtatttttacagggtgctaattgtgccaaatcaagacattgaaattgcataattttaggttaatattagcataatcctacatattttttcagaagcagtgcaggaatagtacaccctgaatatttttccatcatgatggaattttcaaatatcacaacctttacattgtcagttgtctgctggaacattatattgtgtcaaagagatttataaaagagaagggcaaagaaaatttgcggagttctagacaatagtaatatcagggacacttttgctttctttgttattactaaggagttaaataatcagataccaagcataggtaaagaaatgaatctctaactatttgagtacttatcaatttatctcaaggatatttacggtgttttcccctaagccaaaatagagtgcttaattaaggtccccttagccccctaaaaatcactcaggccaagtttctgatatgtgtgtatacttatatacatattaaagtatatgtatttttgtgtgcactttcagatcaaaaagtcctcgtttatctaaagcaatttcagcttattgatgaggcttttctgttacagcgtcctcctccacagatctgcctgtctagagatttaagcccaataagagtccagcaaagtttaaacaacactttagaaatctaaagaattttaagatttattttaatagtcttagtgataacctgaattgtttgtgagttcttacaaataatgcaatcaacatttaagtaattttattatttttttgtttgtataaatttaaggtatacaagtacatttttgttacatggatatattgcagagtggcgaagtctggttttttgtgtacccatcatgcaaatgatgtaccttttctccattaagcaatttcctatccttcgcccccatcccaccctctcgcccttctgagtctccagtgtctattattccacactctgtgcgcatgtgtacacattatttagcttccacttgtaagtgagaacatgcaatatttgactttctgtttttgagttattccacttaagatgaccaccagttccatccatgttgctgcaaaagacatgatttcattctttactatggctttgtagtatttttcattgtgtatatgaaattgtttattccatacgcaatttgtgtgtgtgtacatatatatatatatatatatatatatatatatatatatatatatatatgcttagacttagaagctaggatagacacacaatggaatactacacaatggaatacattcattcacacacatataaataaaagaatatgtggagatatatctccacatattctttatccaatcatctgtttttaaataatgctattgacttctttagggtgaattttatcaatattgttttggtttaaaacactcaccttaaaagagtcacagtccctaaatgtgcatcctcatatttaaattaggtctcagtaaatttgtgcaaagtgtattctttttaggatggtgttgaacttgctaaattatttatctttaagaatcatcattttgtgtcttttattaatgaaaacaacaattatgtgattgctgatatatttggaaaatgatttctgatgtagattgatttttttattctaaattctgtgtcggtattaaaaatttatagattactaactgtattaatatcgataatactaaattttattgctatttataacttggagtgtactttcatcctcctgaaaaagctgaatgaggtaggcagtattattctgggtttatgtgtgagataactgagactcagaggtaaaatagtgtatccaagcattcatggctcttaaatggaagatataaggggtttgtgaaattactcatggacttttttattcattcattcagttattaaaatgtattcaacatttatcatgtaccaggaacagcgcttagtaccaggaattcaaaggtgcataaaacatcttccttattctaagaggtacatagtgtactggaacaaacagccttgtaaatacataattagaacatgaagtagtatgttaatagaggttttcacaaagctgtggaagcttgtcttatgaagtaactaattccaagggagagaagccttatggaatagtgacattttagatagggtgtcattctaaaatacagcaaaaggcccacagtaaaaaaggaattttggttgttatgaaaattttcagattttctatgttttcagtacagtatacatggtgggctatgtgaatgtttgtatagggaccaaagtaggaagtgaggttgtctgttagagagcgctgagaaaccgaaaatagggagagatgagttggaatatgctgaggaaaagttattaggagttttcaagaaaggccacgacagtggggctagagagaagaggctaaattaaagagtcatttctggtttagaattgataaaatatagagacaagcatgataagaaagaagtcgagaagtaaacgatggtctcaagatttctagcttggaaatcattgactaaaattaaaactaaggactggattaggccattcttgcattgctataaagaaatacctgagactgggtgtttataaagtaaagaggtttaattggctgacgattctgcaggctctacaggaagcatagcaacatctgtttctggggaggcctcagggagcttttactcatggtggaaggcagagcaggtgtaggcatttcacatggcgaaagcagagagagagagttggtggtgggggtgggtggctacctacttttaaacaaccagatcttggagaactcactcattttcatgaggacagtaccaagaggatggtattaaaccgtgagaaaccaccctgatgatccagtcacctctcaccaggccccacctccaacattggggattacaatttaatatgagatttgggtggggacacagatccaaatcatatcaaagacttgcatgggaaaataaggaattgttgacataacatctttgaggttcacatcaaatgttctgatgaggatagtccaagtagcagttggctatatacctcagataagggctgaaatttggagctatgtcataatcagcctagattaagagtcaataatctcctgcccatgggccaattacacccaccacttgtttttgtaaagtagtattgaatcccagccatatccatttgcttatgctccatgtataccttttttttgaacttcaaggcagagttgagtagttgtaacaaaaaccatacggcccacaaagcctgaaatatttgttctcaagatctttatctataaagtttgccaatacctgctgtagatgttagttgaagctttgaaagcaaatgaggtttcataaggcagtgtccatacaagacatttaacaagtttacctataaaaactagaattcctttgaggggaacacatcctagtctccattaagcacagtagaagagtcccctataatgggaaagaggtcactttaggtgttgatgttggtggtacaggtcaaagaaaatttatctttgctgtttattcagaatgcaataagtgaagttatgagaaataagggaaaaaatgtgtagaatttcaacagcgaagagaggggataaaggcatgagaatgagttcctaagctcaagtattataaacactgtgagaaacttaaaatcaaagtatgactccaaacgtatttgaagcctgagaacaaggctcacaacctagggaggattagggatcaataaaatagagtgttacaaagtataatgtcaatccagagttgtaaaaatatcagcattgaatatattgaaagcagtaaaactgaatgaggagactatcattttatatcactgtgtttatttctttgccttgttctataaatatttaaaattataaaatttttattaacagtgagagcagaactaccagagtgagcagatcaaaattgggacagatgcttttcactgcacacacttttatttttctgctgttcatgcattatcttgtacagtgcacatgttttacctaaaaaattaaaatggagtctcctgcttaggaaaaaagtatatattctgtttcaaactatatacaaaaataaaatcccaggtgactaaaaactgacatgagaaaaaaacaaattgataaagcttttacagtaaaatagaggagaatatgttaattaatatagggtaagaaaaaattgcttacacaaatgatgaagcactaatcatgaataaaaataataaagtggactaccttgtatattaataacatctatacatcaaaagacagcactgagagagtaaaaatgaaacccacagagtaggataaattatttggaatacacacataatggatgaaatgtgtgtattcataattataaagaattcctacaaatctttcagaaaagaacagataatccaatagaaaaatgggaaaagttcttgaaaagtgaaccatggcacaaaaagggcttgtggcctgctggcaatattctgtatcttgacctggatggcatttttaaggtgatcactttatagtaaataactaatgtgttttatgcatcatagtaacgttaagatttttgtcatctttacaaaataagaaatccaaacggccaataaatatataaagaatttctaagtcccattaatggtccaggccatgcaaattaaaactaaaatgaaatatcactgcttaccaaccagaatcattgaaatttataagtctgacaattccatgtggtggtgagaatatacagcaattagaaatttcacacaatgttacttggtctgtgaattgtaaatagaagtgtaaaattacactactgcttcttggagtgaaatccatttggcactatttagtaaattcaaagatctgcataacctatagcccaccaatttcacttctatatatacactctacagaaatgcatatgttcatattccaggagacatgtttgggaatgtcatagcagcatagtaatagccccaaaccaaaactacttcagtatttattaatagtaaaatttgctatagtttgaatgtgtctctttccaaattcaggtgtcgataatgtgctagtactaagaggtagggtgtttaagtggtgattaggccatgagggctccttctttgttaataaaaataagacccttataaacaaggcttcacgcagcattcagtcagcttgctctcttgcccttctaccttctgccttgtgaagatacagcaggaaggccctcaccagacaccaaatgccagagcctttatcttggacttcccagcctccagaactgtgagtgaatacattggtattatttgtaaattacccagtctcaggcattttgttataacagcacaaacagactaagacaatcatacagtgagaaattaatcaacaactaataagcaaagaggtagattaatcttgaaactatgatatagagtgttccatttggctgctggaagttttatttcttggtctgggtgatggtcaccatgggtttatatgaatggttccctatattatgtttcacaacaaaaagcatttaaaaagtaaatatatgtaatgtactcagggataggcatggccaaccatggattctatgctgaaataatgattcagatttcatcagcaggctaatgacactgcctatttaaatactttaagtcctgaaattaaagaaggtaatttctcaagaaggaatttctaatttatgggtgggtctattccccaccagagagacactagcatggctcagattctatgttggtcattttatttgcatttaaagtcttaagccaaatagaggtacactaataatgacaacaactactactactcatacttgtggaacactgccagatgctgttttaagaaatttgcattttcatttgtaactgagcttacttgaatcttctctctttttttcttggttaatctaactactggtctatcaattttacttatcttttcaaagaatcaacattttgtttcattgatcttttatatttttgtttcaatttcatttagttctgctctgatctttgttatttcttttcttctggagctttgtgttggctttgttgttgattctctagttccttcaggtgtgatgttaggtagtcagactgtgaactttcaggctctttgatgtaggcatttggtgctagaaaatttcctcttagccttgcttttgctgtatcccagaggttttgaatagattttgttgtgaatgtgatgaaaacggaacatttgtacactgctggtgattgtaaattagtacaacctacatggaaaacagtatgaagatttcttaaagaactaaaagtagatctaacatttgatctggaaatctcactaccgattatgtacctagaggaagagaattcattatatcaaaaagacacttgcacgcatatgtttatagcagcacaattcacagttgcaaagatatggaaccatcctaagtgccagccgaccaatgagtggataaagaaaatgtggcatatattttcatataccgtgaaatactattcagccacataccatgcaatactactcagccgtagaaaataatgaaataatgtcttttgcagcaactttgatggagctggatgccattattctaagtgaagtaattcaggaatggaaaaccaaatactgtatgttctcacttataagtgggagctacgctgtaggtacacaaaggcagacagagtggtagaatggactttgaagactcagaaggggcagagtgggaaggtagtgagggataaaaaattacctttggggtgtaatgtacactacttgggtgacacgtgcactaaaatatctgattttacttctatacaattcattcatgtaaccaaaaatcacttgtattccaaagactattgaatttgaattttttaaaaacattaataaaataaaagatgtaaaaaaagaaatttatatatactcatttattgagctcccacaattaaccttaggaggtaagtacttcataattggtagtatacttatcttttactaaatatttgtattacttgggaagttgagggttggggagaagtagcaaggtactatgatttggggcagataactaacttatttattcgcacatacagtttggaccatgagacacgagctcaggtccctcctcctcacctaatcaaagatgaaatatgtgggatgggatgaaataatcagcagtccaatgctgagtttccagaccgaagtataaagcaacaatggatatgtcagaagtctactagggtgttatttatttaaatctatttcatggaatttactaccaccttaatggcccgaaagtgttaaagtatgccccagagtaccgaattactccctaaatgtaatttatgcttgagaataatctgactaacttgatttagaacatcagaaaataagttatgctgcacataaatgaagcagcagtgtaattttaaataccggttgcacggtgaatgagaattttaatatttgcaaaattctaaaatcacttgatttattatccttatgtttatactgacatttttttgccctttgttaagttccatccatatttcttcttactgccaagaaaaaaaactttttttcctagaaatattacagaaggcaaaaattatatttgtttccctgaatgctatttttgatgtctctacttgtttctcattgttaccatttgcttcattcatgggcagcccaattaatggagcgagacaaatttagggagcacagtgactaattagatattaaattggtaaatctaactttgtaaaaccagaaaaaatatatatatatttttttcatttggaattttccttggtggaaaagagtttaaaagtagtcatgataaaaaatgtaattttacgtagtaaattcaagaatagatttagactgtgctattaacagcacctattaaatactgaaaagtgtattttaaaattttatgtgaggcttgaaatggagtctaaagtattattactcacattaagtgtcatcacatgtaaagcccatgattttattctttaatattttgtttgaatagttacttatttcaacagtaatttcaataataaaattaaatcaactttacagttttcaaaggtttagcagttgcatgctgtaataaatacttcatatttatatatttataaagtgacagcataagtcatttttattaggtccttgaggatgcaaaagtttggattatacgaggagacgagagaaaaagggaagaagggcatttcagaaatatgctaccgatatgcaaattcacaagtcctaagacagtagcaggggtcgggcagaaagtccatcctgcctccctcttgtgggcctggaacaatggtgtaagtggaaggcctgttccccttctcttcctacctccagctctgtcttacagagctacggataccatgagcaagtgtatgaacccttacggttttcttctcttgggagaatgtaaaggaaagataacttgtagaaacttgtagataacttgtaaaaaggaaaagaattcagggtgagagggggatttgttgaatttgatagaggatggcaattaccaatatgatgagtgattgagaaacaagtctgtgcaacaggtttgaaatcgaaaatctttgaggtgtacaggatcctgaaatgaagaatgggcatttatagcagtatgtcagagaaacagtcacctcctagtagctaaaagtgttggcaaaagtatagttcaagtgattgggtaggaaaaacagcaaaccaagagtggagactgatggttgctacaaaggtggagtggtaagtcgtgaccaactggtacttctctgtgctctggttagctgctgactgtttctcagactgtggtagcaggaggagggttggagttagcagtcatttgcatatgagactgccatttaaaaaaaaattttaaattatttcatttttctgactctcaatatgaaaagcacattgtagacaaattgaaaaatatagaaaaattatataagaaaatatagtctcaccagtatggaacaatgctaactatgttgcatagatttttagattctcattcaaaagcaactctttgactccagtgatgcaaatgcatgtaacatatgcaatgtgcaattcatttttaaagggaataaacttacgatatattcataggtcatttattgtgtgttatataccattgaaaatatatgaatgctaaattattagtaaacatgcaaaaacattggcaagatcattttgttgtggaaggatatattgtatctgaataactctagaataccataaatcatcaaaggcaacattcttatttttcactaactacagttagagaatacctcttcggctaccttcggttgccttttttatgctaccaaaatgctgtctgttttacaagattttaaaggttaagcatataattattcattaaatacaatgagtgcaatgtacatgtagatacattattaaattttgggtagttaataaaaataaggggaaaaaacctctagaactatcacttttaattgtttaactgataaagtgaagcttcatcttggaaaaataatttcacaagagagcatgtgcactggtagaaaagtgccattgaaacaagagatatttgggttagaagcctctctctactatttaataccattttcaccttttggcaaattacttggcctctgttttctccaatggaaaatgggaataataattgttatgctgcagggttattgtaggtgtcaatgaaatgatgtgtctggcactataaaagcacagagcccggtgcctggctattagtaactgtttaataaatgttaattcctttctctgcccaggacatcagtaggcagatgtagcaatttaaaacttctagtgttactttaaattcctgaatgaaggtagaggactgaaaagatatcatggtattcaaaagtatgatccattgcttcttaagaatagagttcagaaaagcttgacagattcctgtactctgaggcagcaccatagccggtaatctgtaggatggctattggttttgtgctcacaaatgcttgcttgggcaggccccaggaaatctggtagactgtaagcccagtaagatttcaaatcttactttacggcagtgtttttcaccttgactgtacattgaaatcacctggatgctttgaaaaataacagcgtcagtgtccaacctccagaaatactgattaagttggtctggaatggagccccaggatcactgtttggttattgttgttgctgtgttttaaatgccccagttgattcttatgtgcaactgtcttaggtaaacatacagccctggttcatattatttctgcctcagtctcttttatgactggaaggtgaccaaatgcttgtttcctaatattctttccatgtgtagtattaacacatttgacttgtactaagttcctgcagtattccaatctaaaattttagtgactacaataaaataagaaggattaaagaaggcatcgcatagtttagtatatcggttatttaatgcttacatgtgagcctacaatatgaattatatctgtcatcttattttaaatattgacagaatctttaatgatagtgacgaattattgatttattggtgtgataatggtattttagttatatttttaaagttttatttgtaataactatatgtatttatggggtacagtgtgacgtttcagtgtaatgtttcattgtgtaatgatcaaatcaggtttcttggcagatccatagcctcaaacatttataatttctctgtggtgagaaaatttaaaattctctttcactattttgaaatatacagcacaatattggtaactttgttcatattactatgcaatagaacactagaacttattactcctttcagttgatgaacaggcagttttggatcaagaataatattgaaagtgatagaatttatgaagtaatttttatccaaaaatattttgaaagggaatatattgcttccaaataatttattacaatgttaagatatttgtaaatttctagaattaaaaaaatatatttttaggaaagaaaatgccaatagtccaaaatagttgctttatctttcttttaatcaataaatatattcattttaaagggaaaaattgcaaccttccatttaaaatcagcttttatattgagtatttttttaaaatgttgtgtgtacatgctaggtgtgtatattaatttttatttgttacttgaaactaaactctgcaaatgcaggaaactatcagagtgatatctttgtcagtataaccaaaaaatatacgctatatctctataatctgttttacataatccatctatttttcttgatccatatgcttttacctgcaggcgatttgacagatctgttgagaaatggcggcgttttcattatgatataaagatatttaatcagtggctaacagaagctgaacagtttctcagaaagacacaaattcctgagaattgggaacatgctaaatacaaatggtatcttaaggtaagtctttgatttgttttttcgaaattgtatttatcttcagcacatctggactctttaacttcttaaagatcaggttctgaagggtgatggaaattacttttgactgttgttgtcatcattatattactagaaagaaaattatcataatgataatattagagcacggtgctatggactttttgtgtcaggatgagagagtttgcctggacggagctggtttatctgataaactgcaaaatataattgaatctgtgacagagggaagcatcgtaacagcaaggtgttttgtggctttggggcagtgtgtatttcggctttatgttggaacctttccagaaggagaacttgtggcatacttagctaaaatgaagttgctagaaatatccatcatgataaaattacagttctgttttcctaaagacaattttgtagtgctgtagcaatatttctatatattctattgacaaaatgccttctgaaatagtccagaggccaaaacaatgcagagttaattgttggtacttattgacattttatggtttatgttaatagggaaacagcatatggatgataaccagtgtgtagtttaatttcaacttgtggtgtcctttgaatatgcaggtaaagatagattagattgtccaggatataatttggttgctaaattacatagtttaggcataagaaacactgtgtttattacacgaagacttaattatttttgcatcttttttagctcaaattgttcatgttgcaatagtcaatcaagtggatttgaattgtagccaatttttaatgccagaaaatactgattaagacagatgagggcaaaaaacacccagtagtttattaaatactttagatatttcaaaatgctggattcacaaaagcagtatcacatttgactttacaagtcttcattctcaaatatgtttccatagtaaatatgccctttaatattaaggagttaagcatttaaacacctatttatatgataagctatttaaacacagaaaatatttttaaaaccttgtgtaattatatgtgtatcaatcaaacttgcatgcacaccagcgttggcatttgtatagagaggaaatgtatggattcccaatctgctttaatatagaagatacattttaaaaatagcactgaagtgaattttgggctaatgtagcataatggggtttctgcctgagaggcagaaacatattagagttatataaaatgttttggggtagatatagaaaccacttgccattttcaatgatatccaacccaaggtagttatatatttcaatttatattttattatcaaattagtacttattgtgaaaaaaatcaagtaacatagaaatttgtaaaagtacctccattctactctttggaggatagttgttcagtatgaattttgctacatatttcaggctgggtttcttggaaagccattgtaaaatggagatttgtatgtagaaggttaactagggagtacttttacgatgaagcaatttgttttgatgtaacttggtgtagttttcttcatgtttcttgttcttgaagtcagttaagctcttgaatctgtgcatttaacatttcatcaaatttagaaacctttcaaccatttttttaaaaaaaatggaactccaattgtacatttattaggctccttaaagtgccccactactcactgatgttatgttcattgtctgtttggtctctcttttctctgtaatttgttttatataatctctattgtcaaattgactaatctttttcaaagtctaatctatggctaatcccatgtagtatatatttttaacatcagacattttcatctcttagaagtaaaagttgggtctttttatttcttccatgtgtctactcaacatgttcagtctttactttcttgactatatggaatacagatataataactgttagaatattcttctctactaattttatcatctgtgtctattctgggttaatttaaattgatttatttttctcctcattaagtgtgttgtttaactgcttctttggatgactggtaatttttgactatatgccagacattgtgaattttaacttagcgcgtgcttgatacttcaaataaattcaaatatattgaaataaatattctcaaacctcgttctggaacacagttaattcacttggaaacaatttgatcttttgagaatcttccttttatgctttgttatgaccagaacagtgtaagtttagggctactttttccccactactgaggcaaaacccttctgagtactctctctgatgtcctgtgaatgataaaatttttcactggggctcgtgggaacaggtggtattactagccacgtgtgagctctggtgattgtttcctttaattcttttgtgaagttctttccttagctttgagtggttttcttgcatacatgaactgatcaagactcagatgaagaataaaataaagctttctacaaatctccaaaatttcctctgtgtatatatcacctctctggtattttgccctgtgatcactagtcagccttgggctgctgaaactctcagcttcatcttttaacaaaagcctcctggcaaggatcactgtccttcaatgtctgatgttcaatgtgttgaaaaccgttgtagcatatattttgtctttttttttttttttttttttttaagtgtttcaggtgtttcaggcaggagattaagttcagcctcctttactccaacttgaaaacaagtccaaaacaaactattttgatgtaatttgatcttttaatacattaacattacacaattttgtgaatatatcataatttaaaattttcagagaatgtctaatggtcctcatttcttgacagtgtggtttagttgaaactgatgaacattttatcaaaacttttcccctcaattggatacttttttttttttgagatggaattttgcttttgtcacccaggctggagtggcatgatctcagctcactgcaacctctgcctccaggcttcaagcaattctcctgccttagcctcccgagtagctgggattacaggtgcccacccccacacctggctaatttttgtatttttagtagagacgagatttcaccatgttggtcaggctggtctagatctccgacctcaggtggtctgcctgtctcagcctcccaaagtgctgggattgcagacgtgagccaccatgcctggccaactggataattttaaaaagaccattttatttagtctattttttctcaatctatagatgagataagaaaaatcattctagatgtccaaggaaaaattctttcagaaaagagctgtgaatgatatcacaaaccccccaaacagttaaggtatttctttcctggttattttatgtccaaaatcatgcatatgaacatgtgcacacacatgagcgtgcacacacacatgaatacatatacacgcacataatgtaccttaggttatctttccattctgagtaattatcgtaaaatgggtaaaatcaaccccgtaagataccttcatcgataaggcaaatcaaagctttggtaatttctgctatcttggcctttgttgattgactaataatgaataagagaatgagtttcaatatttactatgaaattattttagaagacaggatgtagacagtggctgttagcaggcaattgtttggcatgagccagtaatggttactgtgaaaaaaatcaaccaagcagcccatatattaaacaaacacacgcagaagcacgttggagtctgaagcctcatatgtacaattttcagtaaagaaataacttttagatatgaaataaacaaatagatatatgttgtaaacttgtccctatgtattttgatcaaattgcatcatatttttttcactttaaagaagagaatttagtgctttaactgagacttagtgttatcattcaaaatatactgactgccaatagcagtagaaagataatctggttccatgcaactctattttttttcctctgtcgcaagtaaaagacaaaattaagtacatgaattagtgctttttgaagatattccagagcaatataccatgccactatggagaacctctctaaaaatatcccatttttttacctgagaaaaatattgatcatgttatatgccactcaaattggtttattaaattcgttgaatgatatcagcatctcttaatgcattcactaaacaagcagtaattgagtgcatatacaaagttttatcatccaccaaaacagtgacaatccacatgaggctctaatagaagtttagaaagggggttaagtggttaaatgctggactcagaaagattggattcaaatcccaggtcctttagcttaatagttgtagaatcttgtgaaaatatcttaattcttttcatgtctctgatttctcttctctaaaatggaaatataaatgagatgtgtataaagccacttggaatagcattttgcacaaaataattactcattaaatgtaagcccctattataactaatcactctttataagtgattagttcatatcaatacaaactaagacttatttactgaattatcgtctctaaacatccacactgcagaaaaaccaacctggaaatttcataaaaccttatttttatgtagtataatttcttctcaaagcataagggctcttggattaggaattgaggaaaattccaattcagccaaacgcatctgtttcagatagctgacacttctgcctactcatttcctagctaacaagaagaaatgttaatgggagttttcaaaggaaaagctgaacaccatgaaggaaagtgacacaaataatgttagctcatatattgacagggtgaatttgtgtgctttcaagtcccttcagtgaaaataggaaagtagaaattataaaatgccctaacatttaaagctagcatgttcttggagactaggaaaaaataagttttaaaacatgggctatgatagaatgagatggaaaatgtttgtagttgccagtagaaacaataacaattaccattagattaagtatttaaaccagctgaatatttttattaatggaaatggcatctgttttatgaaataatgctgctgaatgaaccatattaaaaatgaccagtatttcctgcagaacgttgtcgcagacatacaagcctgagaccctaaaatcttaaggtattccatttgaaatcgaccttaagacattaacagtagtggtattgtttagatgaaattttttaggctttaaatcaacaaatgttaagcagacatggggagcgaaacaccagtgtgttattctgacatgaataaactgctgtttttagggaaaaaatatagtcttgttaaggttaagctaattggttttctggtatcttttgcaatgttagtgtgttttactgctccataacctatgttatatggtaaatgtgcaatatatttatatatgttgctgtaaagaaatgtaataaaaaactgtttactttgtgatatgaaagtaaaaatttattcattgtcattgagcatacagaagtaaatatggattacatatgtcatattttaatgttcacatggtcccaccatcaaatgttgaaaaacttatagtttaacgtcatattctattgaagaaaaatacactcccttttctcaaatgtgaaatgtccagagagaatggaaaattacatataaagcatgtagttatagcatggtgaccctgctgtgatctctcagatgaggaacaaaagggagaaagaaagagcacactggtgctttggagttgagagaaggcaaaaaaagagtacaaaaatgtcaaagccaagtttagctgctcttcagctctccctttagctgctcttcagctttaccttaccatggttattagtgattgaagaaaattctaaagcactttttaaaggacccaattctgaagagtttagattcagagagcacaatggagttggagtgactcctgctcaaaagtttgagacaagcgagtccatgaaaagaccgtcctcctcttaatggaaatacccaggttttctcattcttctcgccttgctttcagcactcgcagcccagaaagcccttatctaacaggtactgccgttgaaaggtcattgacttgtacaaaaatgatgagtgctgaatagatgtgcataggtcactgacagtatctgctacagagaatgagttttcgtatttttattaggatacacctaacatggcaatctactgcctcaaagaactctataggaggtaagtgaatttatattaatacagattgaattaaaggataatctagaaaaaggcatatgatgtaaaaaaatcagacacaagtatattttctgtatagtcagtttttacattgtgatttcaccagctggctgctgagtttgacggcttcttaacagccacactgctgagattcaaatgctgatagaaactttgatggaaaaatcactggagtaaatatttctaccatctgttgcccttcactgggaccctaacgttaagaataattcataccattgcttgtcctttatatttccccagcagtaataaaatttcataagattttgttttgtggtcacaaagctatcctggtttctgtaactagaagacatacactagcataagggaatcagccggaaaatttactgctaagagaatttgtctctagtcacttactttaaggttacagcaatgtgtaagtgtgggaatacattttaaaatgagcttttcaaagttattagctggtagtggcatgagagttaagtctcttaatacagttaaacagttgggcacttcatccttgcgtaaatattgttacccttttattgctgcttggaaactcctctgcaactttttggcccctatccatcttttcagaagtagtaaataaccaatttactgggagtgtggtaccaggcagaaattccgagaggggctttcaatccttgcccatcaagtgtatctttcagaaataagtatattaaaataattggataatttcagtggcttgttattagacttccgttgtccagcatggcatgtttaagaagatgacagattttcatacattattggaaagaagcaagaacaaaaaaacataacttactgtagtaaccacggtaaagaactgcttaaaatgcaggataaacatgtcatccctaagggattcccattcttagagcatgaaattatcaagagagtaagagactacaaaaaatgagaagaatgctgattgcaaattccaaatagaaaaaatcaaaacaaaactgcgcaccatcattctggaagcaatgagaagcagaaattgtcatttaatgaaatgtaagattaaagttaatagaagtaattttcatgaaataatattttgcaaggacgatgttccagccatattgatcttcgtgttttcttttcacatcccttcttactgttccctagaatgcttgtttctacctttaaatttgcttttctctctaccagagggctctaccctatctccagtttctcaccatgtcccaatctactccctctcagaatttttgtacacttccctttatatatatttgtgctctaattttatattcacagatatgccttttgtaactcccccatcttaaagaaagcacacacgtacgcacacatgcacacacacaaaattgaactctttctgggagatctgcttaactttcttcataactctgtcacttgctgaaactgtagtatgtgttttcatgtttattatcttttccattagaatgaacatattttgggtacttggtctttctcgatcaccaatatacctcggtacgtagaaaaattgattcatatattgaaaatgtaatattcagtagaacgaataaatacataaataaatttaaaaatgatacttttattgtattacctgagacaaatgatccccaagtttgtccttgcttttcatagccaaaacattctctcttacattgagcttccttcacctcttctgtgtacagagcacttaaaattttcacattgcctgatactttaacaatatgatggccctgttctcttacccattggagcatatgttaaataccagaacccatgtaacaaacatatattgtgatcctactgtgtgcaaagcagatactgcttgctgctaggaatacagagctgactaagagctccttttctctttatgagctcacagtctcatgagttcaacgtcttaaggcacaacgtctaaagcaaagggcagtaagtaaacactccagaaagtactggatctggcctaggacaaatggtgggttgtttttccagctgttatttttcctgccccctaattgacagtcctccattacacctctgggatacctagtctgacttgggaaaacctgactttgggaatcagaggcagtctctcttgcttatatatgaggaactctaatggatacttactgtcattagagaaactctgcttctagcctggctccttttgtaaagaaggttgagtccccttggagagcctgcagaacataaccatttgcatgtaatgaacagtttgtaatactttgagattgatgtgcaatttctatttgacaagggaaaaacaattaggattaaccgtggtcgtatatcccagaataccaacgttgtttccacactctaagtgttgttgggtcattatatgagattcataattttgtcctgttgtacccacgtttgcattaccattcagtcttaatttattataccctattaaaagtttttttggtaatttgttcttattgctactcaggcattaaaatgtctgcaggctgtgaaaatgaataaatttaatgtggcagcatagttctcaaaatcctggctttacaactcatagtacaggcttgtattgtaaatcctagttaacatggatttatttgaaaatccaattttactgctaatcttaaataacacatttttcaaacattttatccttgaatttctatttttttataatttatggctgttgtatgtatttacaaaaggacaatgtgtgtacttttaaatactagtaatggattgctgaaacaactgtaactttaaaacaatgcaattgttaaaaaaataaactgtgcagcctggcttaatggaggcttatgaacatatgattaagatatatgctataataagcaaattcactcaactgatagttcataggaactttcaaatttaatctcataaccagtgctatccttcaaagaatggtcagggcaatttaacgagtacatgaccacgcaagataatttcattgaagagtggctgaactgttgaaatattttctagtctccttgggatatcattaagagcagaaattttgaaatggaattgtaatgatgttcagaaaagataagtaggtaactctcttaatacgttttgtgctgctgtaacaaagtacctaagactaggtaataatttgtaatgaacaaaaatgtattggctcacagttctggagactaggaagtctaacattaaggtgtcagcctctggcgagggcctacttgatatgtcatcacatgatggacgattagagggcaagaaagatcaaaagggggctgaactcccacttttataagggaaccaaacccactcgtgagggtggagccctcaatccttaatcacctcctaaagctcccaccccttaatactgtcacaatggcaattaaatttcaacatcagttttggagggaaaaacattgaaaccatagtagtgatactgactactaccacacagggcttgggaggctaccctagctgttgcacccaagagatgaatcttctaatgtgattacctttatcattttttttactttattaaaatacttttattttacatgtatacttttgtctacccaccatttccatgtctgaccactgctactactatgtcctagcataacattccatacatccttaaaaccaagcaaagggtggagttccatctttaaaaactaaacaggcattttggacaacacattcttggcaatggaatctggacaacatttatcaaacatggtagggaaggttctcactctgcattatcaaaacgacagccagatatcaactgttacagaaacgaaatcagatggaaaatttttaacaaattgtttaaactattttcttagagagacttcctccactgccagagatcttgaatagcctctggtcagtcatctggaagcaattcttcacataattcatgaacttggcttccactttaggaagagaaccacctttttctatacttgcttgcatttttgctttaatgtcttctacagaactaggtcctttgggtgttttaggagtttttccttgttttgaaggattcttgtccttttgatcttggtgttgacggttttgagtcttttccattccgatttgacttttgtgcatttttggctggagtatctcatatagatttcttcactggcgctttttcttcagtttcctcatcatcaaaatcatcatcatcatcaaaatcatcatcttcatcagcagcaagttttacttttttctgtggaaccttgctaccacctccaggagcagatcgctttccagatatacttatgagtttcacatcctcctcctgttcgtcttctgactctgtatcttcctccccagctactaaatgctgtccactcacatgcactggccctgaaccacacttcaaccgtaagaccactgatggtgttatttcaaagccctcaagggaaaccatgggctgtacagacattttcaaagctgccagtgttactttaattggactgcctttgtaactcattgcctctgcttcaacaatgtgcaatttatcctttgccccagcccctaaactgaccgttcttaaagataactgttgctcaatttcattattatccaccttaaagtgatcatctttgtcggcctttagttcacaaccaaaaagatagttttggggcctcagaggactcatgtccatcatcgtccatcaggtggcaggacgcacttaggtgggagagaaggcagatgatgataaaggaccactgctcaagagaacagctgtgcaggacagaatcacaccagggagattacctttatcttagaaaacctgaacatcttgtgtactttgacacttctctacatttcacctaacctttaacatcaacacatttattcagaaaacttttacttttggagctgctctgtgtcaggctctatgctaggtgctcaggatattgaaattgatacaatcctaacctattcacatataatccaaggtttgctgaaattgatggacatttaaacaattgaaacatttaagtggtataattagcaaatggacatttaagccataaaaatagcatctaatagatataatagaggtcggtacaccattgatgagtcagagcagaggcaacccaaagagtaactagccagaagaattgggaaagcttcatagagagagcgatatgaaaataagggagagaattgtaaatccatgaaaatgagaaaaagttgaaaagtgatggtgtcagaaaaacttgtggtatgataatgacaagatgagaggaactcttggtaagcgtgttggatgcatggaaagaaatggcacaaaataatgctgaggacattttttattttattgttggttttgttttggttaatttcattttttaaatctagtatgctagtgttcattgtccaaactgtgaatcataaactcagtttgtggatcaacaccggcctttgatttttagtgaaacaaaatagaaaatatcagcattcatcacaaatagatgtttcacagattttttgttttaattgcgactgtgtgtgtgtgggtgtgtgtgtgtgtgtgtgtgtgtgtgtgtgtatgtgagagagagagagagagagagagagagagatggcttggatgtttatcacctccgaatcttatattgaaatgtgatttccaatgttggaggcagggcctggtaggtgtgattggatcatgtgggtggatccttcatgaatgatccctttggtgacaagttagttcatgctatatgtggttgtttaaaagagtatgagacctcaacccccacctgtttcctgctctcccctttgccttccaccatggttggttgtaaacttcctgaggctctcaccagaagtagatgccagtgacatgcttcctgtacagcctgcagaaccgtaagtcaaaagaaaaccccttttctttttaaagcacccagtttcaggtatttctttatagcaatgcaagaagggactaacacagttgtatgtgtatgtgtgtgttgggtgatttctggttgagtgtcacaaggttgtaatatggtgagtgtaaggaagtataagttttagaaaattaagaagccagttcagaaaactaatacttttggaaaatagtacaaaatcaactttacaagaatatacacagaaagatgtaatacaagatttatttcattgcagtaatttataaagttggtttagtgccttgcttttgcatgctgttttaaaaattaccaagaatatgacttcatgtgattttgaaatactcccagcaagataggtagaaaaggtattcttataactcttagacaaaaatttcggaaagtttaaacgctttatcccaaatcataaagctaataaatgaagaatctgggattcaaacaccatattttttttactgttcatcagctagaagttagaaatgttaagccaaaaacattaagtcactgctctgcctaataaatcttgaggaaactaataaaaagaataataccactgactacaggacaaggtcttcctaagagaccttaaatatattaagtgatgaagatgaaacttcttttattcataaaaatgttatttagttatgagtagagctctaattaaacttattttatattgtcatcagtaaagttgagacataacatatttattaatataattataatttgacccatagtgtattaaaagaaggatgttaaaaggagttgttattagagatgatgttagggttgttgatgataataacagtagtcataacataacaaagcacttcataatttaagaagtgccttcaattacattgttactctcatggtaatctctgtttgatatatagatttggcggattctatatcactctaagacataggttactgaggtgacggaggaatttagcaagcggctgtcaaatggaggacatgagcattggattgtgtatggcaagggctgatggtctctaagaaagcctcttggtttccacagggcagaagccctttgaagatcatagccaaggatttagtaattgcctccctttcagaataccctcaagagaaaagcccaccataagacatggttccctacaggcaaaactgcttttccttaaaatttactgttccctgaatatcagccttctttggctcattcaacatagttttcttaagtttcaggacagtgctgcagaccaaaagtttcaacattgaggaaaacaatactacttgtgcagtgaccctacctcagtcagggaggcagatgcctgcctttatgtgagggaataaggaatcaatcatatttccagcactcaagaaagccagtctagtgcagggagagatagatacataaacctcaaagttatgatatagcataatagttttaaatttccataataactgtattttaaaagttttatagaaacagaagagatgacctcagtctggaaaagccagcttggagaatggcaaccaatattaagtggcaaaagctttgggatcccaggcctccagatggagggtgatagcatgggccagacaggtaggttaggaaaactttgcaaaggacattacacggtacacagacaagtctgtgttttagcctataaaccacagttgcagaatgtgtttgagcaaaggcttttggggatgagatttgcacttttcaagatttaagtttgtttaggatacttacggtttgctgtatacttcctgggtttttacattataattacggtttgaactttaaaggaaaactgcagtttagcatacttgaaagagtgcaacttcaagtcatgattggagacagatatttaacagattttgtgatcctgtgatgcttattttcttctcagacataccacatgacaatcatttttaaacagtttatttctactttagcatccatctgaaggtgttgtgtatgttttctgcttgaaaataaagcagtgggctgggtgcggtggctcacgcctgtaatcccagcactttgggaggccgaggcaggcagatcactaggtcaagaaatcgagaccatcctggccaacatggcgaaaccccatctctactaaaaatatgaaaattagccaggcgtggtggtgcatgcctagagtcccagctacttgggaggctgaggcaggagtatcgcttgaacccgagaggcggaggtcgcagtgagccaagatcgtgccactgcactccagcctggcgacagagtgagactctgtctcaaaagaaataaaaaagaaaataaagcagtgaatgcgattaagatggatttattatgatcataaagtactcaggagtcttattttaaaagacagcattactgtaattaaaaatatagggaagaaactaatgctgttttgcgtatcattctcagctctctcaaaatcagatattaagctcttgctgccaaaggagactatactgcacggtgctcacctgcataaactttgagagggttgaattgtgccaagcaattctctcaatacataaattaaccaaatatttgttgacctactgtgtgacaagtattattccaggaaataagagatccagcaatgaaacaagtatggcttcttatagagttcccaaaaaggaaataaaaggatatacgtatagtgatatccctgaattaaatttctcttttgaaaataaaaattctatcataagctgtaactgccaacacttcaatactcattcagcagttttcagggatttgtaccttttgacttatgagaatttggaagtctaattgtatcattgcactggagtcttaaagaaacagataagcgaatgactttgcctgtatcattgttgactgtacttacaatcagaaaggggcacaggacagatgccagggagtaagtggacagcccataaatggaatggtaagaaagaagaactatagtggatttggaaagttcccttcagcattttccctagacaatctttggctgtgtttgcatgatcagtatttcattcacaggatattgagctcttgatatagttctcaaaacccaaaatgaaataagaagtctactctttatttaaattcaaattccagagagttaagtaactttccaggaggtaatctaaatatggcctccttgttggggggggggggggtgtttgaatttgcatataaatagtctcacccttaaaggaaaaccacagatggtggtaatgatgtagtcataatgtacatctccacagtggtggaacaaaatatccacagttttgctttccccagtttcagtgacccatggtcaactgctgtctgaaaataggtgactacaatacaataagatattttaagagagagaaagaaagatcacattcacatgattttcattacaatgtattgttataattgttctatttttattcatgatttttaatctcttaactgcgccaaatttataaattaaaatttatcacaagtacatatagtttatatagggctcagtactatctgcagtttcagacatccactgggagtcttggaatgtatcccctacagataaggggtaaaccactgtatcctatttgtgtgaatgctacaggtgttgtgagctcataacaatatgacatcaacactgaactaatccaggatttggtagtgagagtgatgtatttgcaaggagtgagacgtggtgcctcatccaagcagagaaataattttgaaatttgcctgacaataaaaatcacaatgtgaggtctctctttagagctgcaaagtccaattcagtgccccctagccacataagatactgagctcttaaaatgcggctagtactaattgagatgggcactgagtataacacacatgccagggtttgaatacttagaaccaaaaaggaagtaaatgctcatttattgcatgttaaaattatggttttattatagttgattaaataaaatatataattaaattgacttcattttgcttttaaaaatgtggctatgaaaaatttcaaattatatatgtgtgtgattacatatgtgtgttttcacatatgtaactgatgttacatgtgaaattgattgttacatgtgacatgtaaaacacgttacctaacacgtgcatatgtatgcaacacatatgtaacgtgttacatatataacacgttacatatgtattgttacatgtgtgcttgcattacacacatgcataatatgaaattacatgtaatttcaaattacatgtgtatattttgaaaattacaaattacgtattttgttatttttgctttacaaagtcaaatttaccctatttaataaagcatcatgagttttttataactagtaaactttgagacttttgtaggagaataaataatgcttattataaaaactgattggaaaagtgagctggagcagggagcggaggaaaaaggactagagatcacctttcttcccagctccgctcctctcccaaccttttttctttccattctctcatcccaattcaaaagtgcagagttcacagttggtgtgctgatttagaaaacagatatataaacagccttaaattttctccaggcttttacaatgaaaagaagttcaatatcaaaagtaacaatataatctgtggaaaggtatagggggctatgtttttgaggtagaaactataggtgctcctggccaagcatggtggttcaagcctgtaatcccagcactttgggaagctggggcgagagtattgcttgagcccagaagtttgagtctagcctggcctacagggtgaaactccacctctactaaaaatacacacacacacacacacacacacacacacacacacacacacacacaaaagccttgcgtggtggcgcttgctgatagtcccagctactcaggaggctgaggcgggaagattgcttgaacctgggagacagaggttgcagtgagctgagatagcaccactgcactccgacctgggtgacagagtaagactgtctcaaaaaaaaaagaaaagaaagaaagtataggcactccttatatgcagctgctcacacccctcctccttcacacccctcccccttcacacccctcccccttccccaaaatttgcaaggggaaaaatgtgtgtaattggcagtatttagtggcgtgcaaccgtgagtcatcagactgcacatcctcacttctgctagtggctcagtacccaacagcactcagtgaaaactaactcatttcaaaggtgaaaacaagtgagtttggccaccagggagtgttcaaaactgtcagtgctgaagcaaatgtggagggtgttctgtagtttgttcaggttgatatttgtggtccaacccctagctgaactactaattattaatatctgtcttgatggtgcctcaggagaaagcttctcaaagggaatcaatgttcaaattatagtaggtatcttggccatggaagttattgaattttagccaatacttgctactctttcatttatagtgtgagaatgcagtgtaatgaacctgactctcactgtcctgacttgcctttctcatcgcattcacaataagcacgtcaatacgtatacacatttcatatttctaaagtttactttatttccttattgtacatcgctgtgctgctgatggaagagaaaaggaaaaacactattgattgcaaaactgttttatctttggtggcttagattttttttgtatgatatgtaacgtcttgcatacctaaggcaacacgaagctaaatagatttgcatatagcatgtattttttccaattaaatgtttaattttgttcagagtatactggggacattttgaataatggagaaaagtacaaagaaaattcataattctaccacctatcagcacagtgaaattttatgaagaaacataattttcatgtaaatcatagtgaactcacggtaggttttatttaatacagtaattggagagctggtaggaagacaaaactggttcaaaagagaatacaagaaacaaatgcttctataatgagtgaatttttaaaaaagtattctggaataagattagtgaataagatactaaactcgttgataccctacagcctttggggttatatcctctactgggtaaaaagtcatttacatcatatcagttttctaaaatttgcattgaacttcatagcgttgtaacatgtgtgggcccaaattaatagtaaacagtaagagttgctttactctgaaaatattgaagctcttgtgagggtgtgaggagtttgttagaaaacaacgctaccattattttgaaacacacacgatcatcttttgttttacttctaagttttggataatttttcttaaattatcttattatcttatccattttcttaatttccttaaccttttaaatgtttctcctaggcacttttattgatttttggaatatagttgatatgtgctgaatttttatcatccagttttaattctactgaaaaatctaaaagatgttcatcaactactatatttcaaatgcatacatcccctttcatgctaaagaaactgtatgggaaacacagtctgacattttcaggacctggtatcattaaaagtcttgacactgttaaaattaaacaacgccttttttaaaatcaaaggatacaaaagggctgtgttggtcagaggatacaaaatttcagttagataggagacataagttcatgagatcttttgtacgacatagtgactataattaataataatatgttttcgaaaattactaagagagtcgattttaagtgttctcaccgcaaaaaaatagtatgtgaggtaatgcatatgttaattagctcattttagctagtccacatttttcaatacaatgtgttgtataatacgtgatatatacaacttatattttccaattccaataagtaaaaataaatgtaaattatttgaaataaataaaatgtgaagaacatccacttttcatatgaaaccatgagatattttctgttaaaagattaaatgtccaataaatttttgatgttaacagaaacaaaaatgtttaatatttaaatacatatttgcatgctattgaccccctgaagttcactgctgggctaagtgaaccaactatatcttaagtcaaaaatgctgaaattcttccccaaatcccaaagctcatgaaaacataaacagaaaatttccaaataattctacagggaaaataagacacactatttgatctgatcaaacaacgggatgattatggttaataatgagttacttgtacatttaaaaataactaaaggagtgtgattggattgtttgtaacacaaaggagaaatgcttgaagggatggataccccgttctccatgatgtgattattacccattgcctgcctgtgtcaaaacatctcatgtaccctacaaatatatactcctacgatgtacccacaaaaattaaaataaaaaagagagggacccgaagataagctaatatttaagctcatcatacttattaagataagcaatacataccgaaagtaatagcatttaaaaccagatgttgggggagggttctaacttgttcattaaaattcaaagtcacctgtcttgttttttcttttgtttttgtttttttttttttttttttgagatggagtctcgctctgtcaccccaggctggagtacagtggcgcgatcttggctcactgcaagctctgcctcccgggtttacgccattctcctgcctcagcctcccgagtagctggtactacaggcgctggctaccacgccccgctaatttttttgtatttttagtagagacggggtttcaccgtgttagccaggatggtctcgatctcctgacctcgtgatctgcccaccttggcctcccaaagtgctgggattacaggcgtgagccaccgtgccaggccacctgtcttgttttatcatgatcccgagagtatatatgtatgtgtacagctcatctaaaccctttttctttcaacatgatcaatagattgaacattggagatattttataagaaataatgaagacaactcaatcagcacatatatatattaaatgtggaatctataatgattgcgaagcctgaagcaaactaaatattcagtaataggttctttttttccatggtatatccatttgaatatataacataaatgccttacatttgttttaactatttaaggtttatgttgttagtgtgatgaaatggctggcaaaagtcagaaactcaggaaagtttcaggcttatatctggagcctggttttctttcttcaaggtagaacctctgtgaagtgaaaaattttttttatatctggagcaataatgtagaagcttaaatgtattatccaagttgtcataagcctattatttctttacattactgaagtgaaagacagcattaatggctaaatgccatacttggctataatttatattgtttaggactggaaatgagcctgaaatgtacatttttttccaaaatagttcatgtaatatttgaaacctgacaagtaacctgatgatttcatggaataccatcaaatataaatgtgaagttttaaagacacagggaaatactcagaataaaccccctaaccacaggccagcagaagaactagacttgagaaaatgaatgggaagatagatagtaacaaatgacttctttggcagccttatatatgcttagtcttatagactgttttatggatgctctgcactctatttccagcaagtatggcatttggaacaggaccacacgagacaaactatgagttcacatttcccacaactgcacagatagaaagagggaacaacagaatactccctttcttcttgaaacaataacttctgttgaagctcactggcttcttttcagctgtttctgctagctcctcctccgcctcttgacctctaaggcaatgctcttcaaaatttcaagactgctttctaattgaaacaaaacttataagcacatttcttcccacaaaatgtacatttatttgtaaatcatatatgaatatgactaagcatgtaaacgtatgtgaaaatagaaatcaataaatataaatgcaaacacaaatagaagcattcacagttttcttttgtgtcccagtgagttgttccaaattcctcggaggtaggtatgtcacagtttgagactataccttcaatcctagggtttctggtttcgctctcctcctaggtgatagcatccatttctacggacttaactgccatctttagttgaataactcctctatctttccatcccatatttctcttgattccaaacctgcttgttcacctgagcatatgacacaattcattggctgccgcacatgcagctttgacattttatttaaaatctttccccttccccagccctcatctatttcacagtagtatcttcttcttatctacttgattggtaagcagagtccacatgattccatcatttatctcccattttatatctaatctataagcaagtaatgcaatgcaacttctgtctccaaaaatttattttgaatttgccttctcttcctctgcatctcccccatcttaggccaggtcacctctgccctcttgccagattaggtcacattctcttactactgttgttattctcttcctattcaatcctacaccgcagcaaaatggatcttctcaaaatgtcagctagataaaggcatttctgtgcttaaggccctcatggatttatcttattaggatgaacacccaactctttattatggcttagaatacaatgaattacaacacataatgaatatattatatttctatctttaccattttcttcttaagtcaacctttctcaatccatataggataatcatattagtgcttcctcactttctaaaacatctcagggcctttgcacgtgtttctctgttcttagacccagaatgctcttccttttctctttgtgtagctaggtgcttctttccatttacgtatcacatgaaatgcagtcattccctcctccttccctcactacctcacaaaaagttgatgcctctgttaaaccatgaatggaattttactcggcagtgaatagaggaaaaaccaatggtaaaagcaaccatatgaatgaatgaatgtcaaaaatattatgctgagccaaaagtcatagacacaaatatgggtatttacatgaagttaaagcacagcaaaactcaattacggtaatagaattaagaaagtggttacctctgggtgagggttggaattgagtggacagaggcattagtgactttttcggggtaatggaaatgttgtctattttgttcaggtggtgaatacatagatacattcaattgtcaaaacacatccatccaaacacttagacttttgcactttattatatgcaaattatgcctcaactgaaaaaagtttgttttcaaaattatatcaacagttgaaattcttttaaagatttgattcaaatgagattaattctgtatccatcattgatgtatgatagttttgtatgtagttaaggttattggagataattgaaagttatactcacaagaaggctgcataatatgaagtttatctgccttgatctttaatagctttcgcgatttcaacttcttcacagctctgtaagaaggcagtgtggcatgttgaagcaagcatgtgttttagagtaacacagagctggtatacaaccccatgtctaccaattatcaatgatgtgggtatgttgctggatctcaataatcttccactgtgaaatggaatgtaacacctgactcacaacgcaaaggtatttaccttatgtaatataattcctgcgatcctgggacctcccttaatcccatccacagatgccaggttaaagaccccatcacagactagaacaagttgggatgtcaaaatgaataaatattaatcgaagggcctattgtgattgaacaccacgcagtaggcactctctaatacctaccgtctccctcctttttgggggaaacattctaaatgtgcaaaaaataaagggttatttgctttctggcacttgggatcgatttattgaggatatgttagcagaacagcaaaggtgaaacactaaaagcaccatcaatacacaggcagaggtgaagccataaagcctttattttttaaattaatgcacaatatataagaggtatgttagaatgaacgtccaatccctgaaaggatatacgaaagacattcataaaattacatgggcatgttttcttaatgttcaaaatattgttttaattagtgtattatgagtttattcatgtgtctgtgtgttgtgttatattaatcttttcttgcattgctataaagaaatacctgagactgggtaatggatgagaaaagacacttacttggctcacagttctgcaggctgtaccggaagcatagcagcatctccttctgtggaggcttcgggaagcttccagtcgtggcagaaggcagaacgggagcaggcacttcacctggctagagcaggagcaagagagacagaatgaagtaccacacacgtgtaaacagccagatctcagagaactcactcatcatcatgaggatggcaccaagaggatggtgttaaaccattcatgagaaatccacacacatgatccagtcacctcccaccaggccccacctccaacactgggaattacatttcaagatgagatttgggcggggacacatatccaaatgatatccatgtttaatcagaaaaataaaagttaacagtaacagtgattttactttgtagacctttgctaatggctgaaatctagctccattccgagaacagcctgcggtacacattttgaaagatagttgattaatatgaaagaagccttatctgtagtccttaaggccattatggtttacatatatgagtaaatattccaaagtagccatgccagttaacatatatccagagtctaaaggccactgggcgacaaaagtaaaagatacatagcaattgttactttatatcacagtaattcttgtatattttaaatggatatttgcatttgaggatatccacttaagagttaggtacatggctcttacatttaagtaacatttacttaaatttctggctgcagcaattccacataggtagaaatgaagtctgaattgagttgggggtctttgcagtgctctctctgttcattggctattttgacaatgctgagagatgtggttagccattctttttcatttcatattggcaacctagagagcaattaagccttctccccttaactagatgtatgttttactcatttctggatctttatggctgactttgaatcctagcctgtggtagaaagcatggtgtcagaaggaactatgagttaagactatgcatacttggctttgagtcttgggtatcatacctccctcatagagtgaaggaaccagggattcttcttgaggcccagacccggcatccatgttaagaatacctgtgcaattttgcttcctgatatttaaggtgaaaatgcatgtttgggtcattgtgaggattatgtgagatgttacttttaaatataggcccccttattatatgctctcatagtttcaggcaacacttgtcgtatttgtaacctcagttttaactgtaatgtttccatcaatgtccctcttacctggtacaggggctcttcatattcttggattacaaatctgtgaatgcaaccatgcatcaaaaatattcagaaaaacaatgaatgcctacctctgtactgatgatttataggtgtttttcttgtcattattccctaaacagtacaatgtaataagtatttatatagcatttacattgtattaagtattataagtaatctagagatgttttaaagtatataggaggatgtgtgtaggttgtatggaaatagtatgtcattttatatgtcacttgaacatttgtggatttgctatccgtggggatcctggaaccaatcccccatggatactgagggacaattgtattataagcagcaagagggaaaggaatctgtctattttgcccaaaatcgtgttcccgggacctagcatagctcctggcaaagagtatacaacaaatatgcattgaggagagaacagagggaaccattatccccttattctcgctgttccttcatgtaatgaataaacagtcaaatcttacaagagattttaaaccagtcagagaaaagttggaagttagttagttgttcatacattgagaagcctcgacgctgtgtcatctaggtaatgaaagatctagggaagtttagcagggagaagaagagagatgatagttgtcttcaaatgtttgaaggactgttacggacacaaaaatttaaacttgtgctgaataattccaagaggtacacagtctctcgatagaagctaaagtggggggtgacatttgactcaacaaaaagccatctaaatatcagaactttcaaaagcaggaactggtgcctcaattaatagtgtgttttctagcacttatgatacctgatcataggcaagataatgaaaaattgggacctgggagttatacatgggaatttgtttatcagttgggtgattaggagaggtggccttaaagtcctgttgtgttctaagagtctgtgattctgagtcttatttcccaacaagagaggtacagagcagaagatgggattgggagaaataggataaagataccaggaaatcctaaaggtaagaaaaggaaggcagacctgaagctaactctatacttcaggtgcttgcctagagccagccctacctacttagagaatgttgaagagccagttaaaacatctttaacacggatgtaaaacaaaactatcaaaacctgaagatttcgaatgttctaacctactcgtcagttgggcttttttcacaaatacttcagtaaataggcataaatttattttttaatgatagaaaatatctcttaaagaacttataactgtggataaaagcaccaccataaaaatcttgtggtgaaatatatatatatatatatatatatatatatatataaaattttaaatatggttagctagaatatgacgacaatgtttatgaaacacagagactcttgacaagtcccatgtatacactataaaactttaagttatccactattcactcactaagcttatacttaatgagtgtctgctgtgtcacttattgcggaaggcacaggcggtatagcattgcacaaaacatatgtggtctctgatggagtttttcagtctagtggtgaaagcagtgaatgggtgtacagatgttaaataattgtacaattagttgcatgtgtaaacgtcaaagttcagaagatgacaattgatctacggcaatgtttctcaatctctgacgttttgagccaaatacatctttgttgtggtggactgccctgtccactataggatgtttggcatcacaactgacctctgcccattagatgccaatagtactctcttctttaatcacaaatttgtcccagacatttccaaatgtcccttggggagcaaaatcatccctagttgaaaatcactggtctagggggaggtctttatgaggaagtaacatctaagaaagctggtatgtttacatatagctacagtctattacacatgtatacatatgtaacaagcctgcatgttgtgcacatgtaccctagaacttaaagtataataaaaaaaatgtaacaaaacaatacagtatgataagtgctatgggaccaaagatgaaagggttctactgcacagttatgaactcatagttaggcttttggggtcaaaattttgctgaagatatttgccacccacgtgacctttggcaggtgacttagcttattcatgcctcagttttatccaatgtgaaatggggctggaaagtcccatgtacttcctaataactttgcggaaataatatgtggttatataggaaaaaaaaaaaaatcctagaagtatgcctgctgcgtagtaaaaggaaggagaaggataaagagaaatctgcattttttcttctgtaatggggcagatagtaaatattttaagttttgtggcccaaatagtctctgtcacatttacttgattctgcagttgtggcattggaagcagctatggacaatacttaaattagtaggtgtgcctgtgctttcaataaaattttataaatacaaagtttgcaaaacaaagttgttttttttttttttgtagtttgctgacaccctagtaaagaagcaccattgtcaacgttaaaaattatcaaatttttatttttcaaagttttcaaatttgctttgcttggtctagctcatgaaataagtcaaaagtagcaagacctccacctctaaaataataatagtaatgataacctcaaaaggaaagaagaaatatttttaaagaagaaaaattattgttaaataggattattgtgcagagaaaacctaggagactcaattttaaaatctgtgaaataattttaaaaatactttatgaatagatacataatagcttttattcatattaatgactataaatgcaaatggaaatatttcattcacactgatgacaatgtataaattaaggaggaataaaaattgtagaccctataggtgaaaagcataaaaatatacataagaaaaagcaaaaattgactacgtaggattgttttaggatttaagatttattgtcattaaacttgcaataccagccaagttaacatttgaatttaatacagttataatcagaatgcttttgatgtgtttgggggcaatataatttcaaaggaaataggcaatgatgtaatttaaagtttatatagaaggaaattgtgtgcgtgtatgtgtgtgtataaattggaaacaattttattaataagcatattatggcagcaacatacacttccagatttctactatactttgaagtaattgtgatcaaaaccacagtgtgctggcataaggctagagaaatgggttagtggtttacaagtgagagtccaggaaaacatccaaataagattggatattttagttctgtgtggatagcctatttcacttaataaatagtgtctcgtaattgactattcatgtacctataagtttaactatagaccaaaaaaacgccctactagattaaggagctaactagaaatataaattcatataaacaataaaggaaagtgtaggactttataagcttcatgggagacagatttttggtaagtcaggaagcctggaagacttaaaacataaaattggcagactgaattaactgatagtttaaagcttccatagagcaaaataaatcataaaccaagttttaaaatatataatggatttagagaaggtatttacaaaaatatatgactaatggaggttaataataacaatatgtaagaaggatatgaaatggcattttactataaaggtcaaacaaatgacctataagcataataaatcatattaatctccactagtaataactacacacatctacataatatagatgttacgcctgcatttgatttactttatctgtcttttggcagaactatttgtcaccagataaaaaattctatatcattaccagaaaggtatattattataatgtttattatgttgcagttgtaaaagaaataacagcttttcaattgtttacaaatcctatagaacatttactgaaatacatttacattttgtggcaaacttggatttaaataccgtgttcgtgctttgttttatgccgttttcccatcttttctccaggaatttgattgtgcttcattgaaagctaaaaagaaaaaaaaaataattctggttttggtttaaaaaattaggttaggggttaaaaagttgtacgttgtcttctgtaaaaataaaaaacaagttttctttgtttcttggaggctttatattaaatggatttttaattcatagacagcatattgtgatgaaatttccccatgagcttcacattttgtttcaatagcagaaactaacttggttgcagttactgcccttctgagaacagtgttctggaataattttgacatacatatgtatctctttttaaaacatgtgttaatcttttcataaagaaagttttcccagctgtgtcacctgtgactccaactttctggggggacagggatatgagatgttggaagggaatggcttgaagaaataaagtgcaaaagacgtaatgctttcctgtggtagaaatgtattcagtgaccctgaatgaccttcctactcttgtcccttcatttttcccacaagtatggtctgggcaattataaaaattgacatttgcagtgggctcttctgtaaaagatgctcaatcagaaatgatttattttagaaaaagagatgatataaacatatatatcccctgtctcggaagtgtgaaggttgaaaagcaaggagatgatcttcaaagtgtctaaaatattgatttgtaacatcgttttatgaaagtgcttcagattattttttttcttggatggccccttatgctttggtcagttgatgctaaaatctgaacttctttattttaaaaaaaacttttaattttgaaaaaggaagttcacggtgctgtctaattctttttagatagtcattaatgtaaatgtaagagtcattctgagaaccacatctgctgatatgttccgttaaattacaagttctatgtgtatttgctttgctttcatacaatgaatcttctttactctcttccccacctgccagaaattgccccactcaacgttcataaaaggtccattttcaatcgctatatttatttcagaagcagagatatcatatattcaaattttagttactttccaatatcaagctaataactcacacaaataaatcaaactacagcaaaacagcaatctagcattcaacaaaacctccccaatgcacatatttcaagctgtagatatgtatcatccaccatgctgaaataatgtacatgttcaaatcaaatggaaaactagaatcaaaattgttgattacttcttatcagggcattttattatatttaagaaaaatacaaattaaatcattttcaggaagcaatccttctggctaagatttttttagcataatgcttaaagttaattgttgatctttatctataaattcaaaggtggactaaaaatgcagaatcaatcaggtagtccattttgcatcaggtgaaatatataaagcataaaacagcgagttacatttcctaacaaaattgaattacagtgagtaaaagtgacaggacaaatgcattaagaaaagatggactgaaatggatagagtagaatatatgcatctataaaacacagtcatatataatacactcattttttttcttacgagtgtgagattaatggaagaaaacaacaataataacaaaaccagtgtgatgtgtcagatttcaccttttaattaaaaaattattcacttcagaggggaattttctttcttgggttagctcaatcatgtcagatcttgttcatttaaaaggtcagtttacttgccttctgaggtttttgtttgggaaaaagaaaagaaaatagattttcattggtatcctgggtagaattaattgtttatcattcatttttaagatctccgagaggcagaaaaaggggaactgtgcaacccttttgtccttctggatctcaaaatgaagggatacattctgctacatgaaatgtggaattaagaccatgatgcaacatgataaacaacacaaatttgggggtgtctctgtgctatacattattgaatttttccatgctatacactttttggatgtgtctgtgctatttattcagtttttttaaataaaagtttttgtagactaaattgccctctctactttgcatcgtttttgaacaaaggattttcaagactgataagctcaaatgtatcatttattgtattcaagtagcattcaatttttctttagaagtataatttgtagatattttaacacagaaaacttgcaacactgctcatgataggcacttattatatattttttgaaagactatatggataatgattctaactttgacttttcctgttttgccttcactttagaattaagcagagaatcaaatccatattcctgggggcgatgcttggacaacagtatctctttaaagatctttgtgtgagtcgaaggtgcagccagactgggagttattgtgaagaaacagattcaggaaggttgagaaacttgcctaaggctaatcagatagttactggcaatgttgtttctaaatcactgtttggctccctcattcaatgaatctacactatgtgggactgcctcttgctcctgacatcttttgctgctgaaataaatgaactcaaagcctagaaggtagaaaagagggagttcagaattatattcaggcacaaataccaataaggctattgcccccagaactgcaacttctcttggtttaacagataactatttagctgtgaggtacaactgaggaagtggacacacaagttatcaggagattctgatgtgccagtttatatttcttgtcacaggtaatgattcgaaatttcttaaaacagctgtcctcacagtggagtaacctgggagtacatgaaggcattccaaggagtaggcacagatagttttaagggaatttatttctagatcttctactttattttgtactcttcctgaaaactgaattgcctgaaaaaaaaaaaaaaaaaaaaaagacatctgtagtcaagacctcaggctgtttctcctttctaaccacttgccttttctaaccacttctcccaatttaagaaaaaaagccttatatttcatccaactctgatcttactaaggcttcaaacaaaagaagcatgaatgactttcatgacagggcaacatagctttttgcaagaagagtggttgctaactctttgctttcaactgaacccgaagagaagacctgataagttgtcagccgatagatcattaaaaatacgttttggtaagcaatcatcatgtacttttagcatatgccatagcaggagcacaaatgattaagcaatgctactataatacaattccttccgtttctttctactcacctatttgaataagatttttcatcatttacatctatacagacaaaaattagggatagaattgatgctgaagcctttccaattgtagaattaatttatattcttctgaaggtgtataaattgttaaatacccatccatcttattaagagatgtattttcaataaaattttatttttatgtttatcaaattttataatatacatatattgttttggtcaattgcacgttaataattgtaacaatacctcaattgaaaaggtttgttttttacatttaggacttacagtaacagaaaaaaaacactcattgtgtatacatactgtttaagaaaagtatactaggtgatcaataagattttttcaggcataaacatatatcttagttttaagatatcgatatttacaatgtccctcaaattatattattttcagtcatttaagaatgaaaagtacatttcgaatgcggattttaaatctgcaagggttgactcatttttcaagagtctttttaggggatacagaagcaagaatgtttggagttccctgatcagtatctttaagagaaggtatttgttggtagttcctagcaaattccaacagcctgatgctacttaaaagataatagtaattattttaaataatgcttctgataaaaaacattcatgcacactcagtttaaaaagatatttaaacatttgtagttgtagtttgggaactcatgatacaagtacagtctgtaaatgaagctcttagtttgcaaatatcagagataagctattaaaatgcagaaattgaaattgccctgatatatgcataaattagtgtcatctccatcttgtcagttagagtattttttagattctctctatgtatacatacatatatatatatatatatttatatatatatatatatttgtgtagctgtgcatgtgtgtatttggactaatgggtcaaaggacagtactaacccaattcaataattaaagaaaacataattttgagaattagctttatggtaattgtttgacttaaatgagtagatcagagaagaataagggctttcccttatttaaacaagcttcatttttttatccaaacatttacttagctgattaagcttcacttgtttattttcttcaaagcattcattcaggtgggtactgagtaaactgaaatatcacaccagggaacttcaacaccatccaagtcttaaaggcttcacttgttcacagttggcatttagtgaatgtctaggctactgataatattgtgagtaagttggcagggatcataagaaatgataaaatacagttcttgaaaatgttatggtttgaggaaaagatctatgtttggaattagactgacttggattcaaactctggctgtacctttgggacaaggtgttcagaaactctagcctatgttttttttctgcaaaatgatcctcttttccaggattcctgtagagattcaaagatatgtgaatgtttagaaaaagaatagacttttgatcattgttaattcccttactttccccaattagacttgtaagactgggaagaaagctacacaaaagattgaacaaattatagctgacagaccatagcaaaagatacagggcaaaacttaaaggggaaaactacacattaaattattttaaaccattaaatagcactaacttttgtcagatattacaaccaaacaccactcaaattaaagtaaactgaataaaatgcctgtttttttctgtttactgatgttttcatttgcttcattcatttattggaagatataaaatgtgttagacactgttaggtgctgagtgtataaaaaaatcttattaatacaatttaaacacgcacacacatatatatggttataacaattgatgccatgtatgtactgtttatatgcctatacattattccacagacctggggggagggggatgtagagtcttaccagaaccataggaatcttctcacatcaacatttccttttgaagtttgttcatgaggcaccatccagataatactaccatctgcaatgtggcttgagaagatgttagatttttttattacacataataaggctgtaaagtatttctgtatttaggtagaggtatgtaatacaatatgtatataaaattacatatccaataaaatctggtgttaaataaggactagcttctatgataatatagtctaaaggcttttcatttggtgttatagaaattatgtgaaatatgtttcctggagtagaattattcgcatttcagctctctgacagtggaagaaaagctagagggagaggtgaacaagagagggagcataatggacaaagctttgctggaagccaaaccaccacttcatatgtcaaatctgacaggcctcccattttaggtgtgctgtcattgaagctttcagctgcaccttgcctgtggctaggctattttcaaagattaaaatgcgaaactggaaattaaatgcaacttaattcccaatttaaatttccattatttttgaaaagtaaaagattaaaagaaatgtataattgcaattctggtggaagaggtaattataggaaaggtgggatgtatttcaagtgggggatatagcttactgcagcagagaggaatctaagctatcattcttttgaaattggtctggaaatatgttttcacatggaaaatatactatatttttaggaatttccttgtcatattactgtatccttttctgttagaatataaattctgaattccctattccactgtagatctgcctccgattatattagctcttctgaagttatcaaaaaataatgagatatacaatattccatatatgtcaaagcaattatttttaggttaagtaataaaccaatgacctttaacccggtaatattctgggttgttcataaaaaaactatattcaggtaataatgtctttccacttaagcaactgaaaaaatacacaatacttaacatttggttaattaaatacctactccagacaaaaggattttctgttttcaagttatcttagcaagctgagcaggaagcaatgatatatccaatcagaatatccatggaagctctgctacagtttcaaaaagttctcatcaggcagcttttaaaatgcctactctgaaaatggtccaggttaaagaacaacagcttcctcgtcagatagcagtattgcttggccatgtttcttcctagcacaaaaaagtacctgctcttctctgagtacctacattctaaggactatggcttacataaaacagcatgggttggggcaatttccagcacactgctcactctcgaaaacgtatgatgcaggtgagagtaatgtttttgtttgaatctgctttcactcgtggaagatgaaactacttgcaaagatctgtactttagctattatgagtaacaaaagactcctaaaatattgcacacattgtggggatggagaaccatcatcctgggatttgatggatcctatggtttggctttgtgtccccacccaaatctcattttgaattgtaatccccacaatccccacatgtcaagggagagagaccaggtggaggtaactgaatcatgggagcaatttctcccatgctgttctcctgatagtgagtgagttctcacaagatctgattgttttataaggggctcttcctgcttcactgggcacttcttcctgccacctgtgaagaaggtggcttgctccttctcaccttatgccacgatggtaagtttcctgaggcctccccagccatgctgaactgtgtgtcaattaaacctctttcttttataaattacccagtctcaggcagttctttatagcagtatgaaaatggactaatagagacgtgtctctcagaagtcacagtgatgcttgaacggatccagagctccttcttcaggaaggtcccaactcattctgaagggtctctccaagcccacctctctctgtaaatgggaaaggttttactttgagcactaaaacctgccagaattctcaattttcctaacagtgtgttaataaacacctactcatttagtatccaaaccaggtctgtatttctcaattagagctcaccaggctttcatcataaagtagagcttcaaattgtctgcaatcccactcctatcaaaaacctagaaggaggtaatatttcagagtaatactataaccagatgaccacatctaagaaactgctgaccctacgatgtaaccttctgtccatttttccctttggaaagtctaggatcttttcttataccagcaagttacaagcctggactacactaacttgctttccgcagaagaaaacaccatgagttctgttttcatattaagcacttagtctccatcagacatcaatcgagaaaaaatcattaaaaatcacattttatatttgatgtatatttctcaataatcctatgtattagttcattttcctactgctatgaagaaatacccaagactgggtaatttataagtaaaaagaggcttaatggactcacagtctcacatgactagggaggcctcacaatcatggtggaaggtgaaggggtagcaaaggcatggcttacatggtggcaggcaagagcgtgtgcaggaaaattgccctttataaaaccatcagatctcctgagacttattcactgccataaggacagcacaagtatttagctccctcagcacagaaccatccccgtgattcaattacctcccaccaggtcactcccatgacacatggggattatgggagctacaattcaagatgagatttggatggggacacagccaaaccatatcatcctatttggatgatcaatattatcaaggtatgctcccctgagggggcgtcctttttaccatttaactccaggacaaaagtttatttctttgtaaggacagtgtttatttcttatggtcctattttctcctaagatccagacaccaaaatggccatctatcattgacttaactcctgaattttgcttagagtaacagatttagtgaatctaaatattttctggctgtggaatgttaatttatacatgttcaagttacctttgattcatgtgacagtttgtgccaaaacacactcattatcagaactcagatcattatgttggctcttgttttcgttactaaaggaagaaaaacagtttctcaaaaagaaaattctgatacctaggaagaccattatacctcactcttttctttatctcatcaccacatccaatattataaaagaacttacaaagtaaaaagaaaggtgttctgtagatgtagcgcctggcttgtatggtagcttaaatgaacacagctaaaaatattttatggctagtgtccaaaacagtctggcaccagacaaaataagaatatttaaaattatattttagagttactttaagaggaagggagagagagatgtaggcaggaggaggaggagcaggaggagagggagagagagagagagagagagagagagagagagagagagagaatctggggtttctatggaagggctaagaatatgtagaaaacagtttacaaagaaatatggtccaagaatcgtgtgtacacacacacacacacacacacacacacacacaccccctggaatatttttcagccttaaaaagaagaagatctgtcatttgtcccaacatggatggacctggaggaccttatgctaaatgaaataagccagaccaagaaagaaaaatattgtatgatctcacttatatatggaatctttttttaaaaaaggtcaaatatatacagatagtgaattaaacagtggttaccagggtcagggtagttgtgaggaaatggggcaatgtaggtcataggatacaaatgattaaaatatattaatatattaaaagatataatatacatcatgaggactacagttaataatagtgtgtattcaagatttttgataaatgaatagattatagctgttcttgccacagagtgaaaaatgggtaactgtgaaatgatagatatgataatgttctccacaatggtaactattttacactatatatataaatatctatgcatcttacaccattatgtggtatcccttaaatatatacaataaaatttattttacaaacacatattaggaatgcatattctgatttttaacaatagttaacctcattaatatatttcacactatcatttctagtgtacatgaaaagtagtttattgacattagttgtaaaaaaaaaaaaaatggtcttgagacttttgggtcagagaatgttctggccataaggtaggtttctgcttgcctactagatatcttaacttcgatttcctgaacatcccatcacttcagaatctctcaatcctttctaacatccgcaacattgtttttctttctgcatttcttatattgactgatggatttataattcactttctctgaaaaaccctgcagttatcatatatccctatccattctggctctttattgcccaaatctctaccaaaatcctgtcagcacagcctctgaaatatttctcaaagcatttataatctggctctcatcaacattttcaacactctgttttatcattccactattttacatcatttcattttcatttttaccacaatcactcatccaacaaataagtatttagctccctcagtaattagtattattattattaattataactagatgctgagcatacagaagtgaacatgacagacataatcccagcagggatgtcagactttatgcaagtaatcaaccatgatgaatctcatgagattctgagagagagagagagagattgagagagagagagaaaggggaaccactggtgtccgagttagaaatttgaattagtatctgggtcaccaaaagcttctgtgaagaagtgatatagacttggccacacaaaactaccgtgaaggtggtggaaatttttctatgcagagtaccacatttaaagagctaagcctgagagtgtcagagataaaggaacagaaagaatgtgacagcagattatgtttggaagaaagatgttcaagagaccaagctaaagaggagatggggctagaacctggagggtccttcgggtcctgttgggagttttttctctgcccagaagggctttgtcacgtggttgtcaggaaagagtcatgattagagctttgattcagagacttctttcgctgaagtgtggagaatggttcagagagaagcaaatctgaatggacaaaagaggttattattgtaatcttggcaagaagcgatggtggtcttgactaaaatagttctagtgagaatgtgacaacaaacctgagaaaaatacaggagacgtaattgacgggggttagtgttaagttgaacgattgcagagttgaatttgaggaaagtgtcatatatcattcccagtttctgatgtcatacacctctggagataacactgccatttcttttgaaatgggaaaataataagtgatcagtaagtacgtattggataaaataatgaatggttaaatgcataaggggagaggaaaagagttgcagagaaagagagtaaacgtattttggatgtgttaattttgagatacctttgaaaaatccaagtgaggggttgggtagtcagagaaatgaatgtggatgtcaggacgaaaggtgaccgtgatgaactgtatgtcttcctctaagcacgttatacagcttcatgtcacaagtgactcacttcatgtcacaagtgactcacaaggtcacttgtgacaagcatttgcctggtgcttcatccctaacctccctttctatactcagctaaaatgtcacctacaatacttcttccttgactccaccgtccccactttactgatatgaatacattttaataaaatgatataataatgcttagtttgtaaacctaatgttcctcaagtggtataattatctgatttgtatgtgatcatcaacccaaccatattaggagcaccttgaaggtagaagatttaggttcatgcttaacaccacatctggaccactgtggatttaactttctacaatgattgtattcattaatatattgggtgcccactatattccaagtaatatcctgcacactacgtacaaggaagcataggtcccgtgtgctcatgaaactgtaattttagtaagcagggataggatacaaactgagaaaggaaaacaatttagaaagtgggaaatattatgcacagaattaataaaaaagagaaaaatcttgaaaaagtcttcaatacctcacttggaaggtgattttgaagaagaactgatggacaaactagagtcagccatgtaatgatgtaggggcaaagcattccgggcacaagggacagcttatgcaaagaccttaaaaatgaactagctttgtatgttggagaaggataaagagaactaaggtatctataaggtaattaggaagaggatgagttatttagtcccttagtctttgaagcacattatctcatacttcaattgagtttattcttagtgtcattcttctggatgcaatatttgagataaatgtcttaatgaacgttcacctccctccgtagtaatgcctgagtgtcacaaaaactttttttgtttacatacgtagccatctaatggaaacataaaataggaatcaaaagttgagtttcatgtacaaaaggtaaggactgtacatgtggtcataacaacttcaaaagcacctgaaggtaacctttaaggaagatacaaaggctaggaaatatctaggatccatgaagacagacttacttaaggtcatagtgtgtccagagttggttcccgccggtgggttcgtggtctcgctgacttcaagaacgaagccacggacctctgcggtgactgttacagctcttaaaggtggcacgaacccaaacagcgagcagcagcaagatttattgtgaagagcaaaagaacaaagcttccacaacgtggaaggggacccaagcaggttgccgctgctggcttgggtggccagcttttattcccttactgtcccctcccatgttccatttctgtcctatcagagtgcccttttttcaatcctccccacgattggctacttttagaatcctactgattggtgcattttacagagcgctgattggtgcgttttacaatcctcttgtaagacgggaaggttcctgattggtgcgttttacaatcctcttgtaagacagaaaagttccccaagtccccactcgacccagaaagtccagctggcctcacctctcaatagcattaagaatatagtttcacgagcatatatgaatcaaaacttacatttgccaattttatttgcttgtttatgtgtttccaacatgtcttgtcttagggccaaatgtttccctagagaataactattccaactatcttagttgctgtatttttatgcaaccttcaactctccatactaaaatgtctccagaatagaaaataaatcttttcaaagtttcaaaagaggctctctatatattccccttaaaagtaccaggcagacatatttctaggtttctaacattgcgtgttgccaggaagtatatccaaaccatcacaagttattcatgtaaccaagcacacttattggagtgcttctgcttctgttcttgcttgaaattggaagctccttccaggaaaaaaaaaaaatatctatagaaggggaaaaaagtaattttactttgaaaataaaatatacgtgagcaatagttttattctgtttttaatttaccatagcttccaaagacaacattgttttatagtaggggttagcaagtgttttctgtaatgtaaacgtaaagggccagagagtaaatattttaggctttgttttctatactctgttgcaactattcaactctgctgttagaatgttgaagcagtcatagacaatagagaaatgaagatgtgtcattgtgatccaataaaactttatttacaaaaatggcaatgggctagttacggcttgagggctgcagtttgcagactctcacttcagagctaacagttgttgtcaggagtcacttgtttttggaaacctacaatgaggtactataacaccaaaaagagttatcccttcctttttctctctcactttttgaattatgagaagaattagaaatgtagttaatgataatgtccaaccagtgtaattatacttgttagaaacacagctggaagcctgttgtccagtcttatttctcctctgtgatcctcattttcagaggttgaagtcataagtttgccatgtctactttctgacaggggaattataataatgtggagtcaccttttgtttgtgactttgacaatgcttcattgacttactcaccaattttctaatttttatgaagactttttgccgaaatgtagactcagtcttctctcttgtctactctttctataacaattaacaatgaacttatttacctttttaacatctttttaaaaattttctatacaccttgaaaatgtgaatacaaagtaatgctgcatcatgtatattgccttattcacacatagcctcttatggtatatcatataaaaatggaacaatacagcaacaggttgaatgaacagtaatcaggtaacaggaaaatgagatgtctttaatatttcacttaaaaactcaatttcctaaagcatacatataaatatttggaagtatagttagaagaaaaatatctttaaaatattttaattgattagtcttatttataagataatttttaggaggctggttgcggtggctcacacctgtaatcccagcactttgggaggccgaggtgggcagatcatgaggtcaggaaatcgagaccatcctggctaacacggtgaaactccgtctctactaaaaatacaaaaattagccgtgcatggcagcgcatgcctgtaatcccagctactcgggaggctgaggcaggagaatcacttgaacctgggaggcggaggttgcagtgagccgagatcgcgccactgcactccagcctggtgacagagctagactccgtctcaataataatcataatcataataataatttttaggaagcatcagaaatatataagaaaaagattattttcttaattgctttactaaaaacacctctatgatttttcagtaaaacttgattcttatgtcatgtgtgagtgtgatctgcctctcttgggatactactgtactcatgaggagtgatttttttctccaacgacctctttgtcacgtcaacaggtcacaggaatagtgtaccctaaaaagccacctgccacatgctgctgaaaatgtaaaagtacacacatacacacacacacacacacacacacacacacacacacacaccaaaatcaggtatcacaagctgaaaataaaattgagtccaatttttttttaattgagcagttaatgtccttaaaacaaaatcctatactgcaacaaatacttagccagatcattctgatacctccaaactgtggtgtattccaagatacctctatgatctttgatttgatccacagcttttcagttatcatgcaaataccttcaagttttatctcatttctcagtgcaaactcattaaaaattttcagctgaattcaattttataaacatgttgtgaatgtcctctttatataagcaaggttgtaaggaactggccacataaacagaaaattgaataacatatggtttctggccttagtgatctcatgtgtgagttaggcatatgggcaaaatcagaacactatagagtataagtctaaaatggtagtattttataatagaggatgaagagggtgctgtgggatcataggtgacagatataactcccgttgtgggacttgagaaaggcttcacagtctggaaacatttagttgctattgaacacaaaataagactcactgttgagagaagggagagggagggcatttcaatcaaattaagattctgtggcatattcggaaactgatgtttttaaaaagagtaatgtttattacattcctctacataaattatatttctatgtaatatgaatgacaaatatttaacacaaaatgccttataacatttgaatgaaatccatcatatgacctgttatctatttccatttcctttttgctcatatcattatgaacaatgacctgataaattttttataagactttgctgaattagtaaaggattattaagtttagaatgaacaaagctgaccaatcattcaggcaaatttgaccgttttgttgtcgcttttcttatttctgaaaccatacaattccctgaaatgaataagtacatatttgataacttcctaaattaaggctcaaaacactggtaatctactgggctttcatttgttccttctatttgtctaatcctatctatatttctttatatgagctatgaaaatattagatttattaagttgtcctttatcttaatagagaagaatgtttttctatgacattaagaggaatttgatttttttctttaatgatctacttttaattttggtagagtagcattgataagatcaatattacacattgttaagtatgcattacatgttgataagataaatattacacttaaaatatgtttatcaaatgtatgaatgataaaaacgaattctgaaatgtatgggaaagatcttgaataaaggtctatgtacatttcaaggatgtctacatatgcaaattatcataatataataactattgaatatgattatcttcacatactttctttatttttcatctcttagatgaaattgggtattgttttcttatagctggaacaaagcattacagagaattcttagtgtgatttcattgaaactcactgttatatgagttcaacaaagtttaaattagtccatgacttaatcatcctttataaatcctatcactagtattcggtaaggacaaagtcaattaaaaaattagcaacagaagcattaaaagaaggattaataaatacaaaataagggatgtgatatctttacgtattgctgagatgttagtgctaaggaaaaacttccctgttcataatgtgaggtgggaaaaagaagaactattattgtatatttctcctctctaaaactgcctatctgactgtgtttttctgtgtcagccgtattaacagatgtttaattttactcactttagtatataaggcatcataatgtatgaactatttcaaaggccctatgatggctaattaaataaaaatatattaaatattagctggacaaaataaaatatgtattaattttggaaaaagtagatcaaggttttgcagatcttttcatatcaatatattcatttgctgaataagcttttattgtttaccaatattactagttttatagagatgtagatatcaccacagtatgactaattttatagggacacagatagatagatgttattttattccaatcttatttttacatataacaggtataaatatgcgcttgaaaggagtatatcacttaggagtcagtcagaaaagtaaagatcttctagtctaatacagtggttctcagccaggggtgattctgctgcacgctgagggataaattggcaatttctggagacatttttggttgtgacaattgcaggagtgttactggtattcatttggtagagacagagatattggtagacactgtacaggacacaggaaagtctcttacaacaaagaattattctgtccaaaatgtcagttgtggtgaggttgggaaacactggtctggaagaaggaatttactatgaggaactagttacgaaagtatagagacatttaacaagctgaacaaaggatagtgagatggctcagagattagcaactgtggcatgaagccactactacgtttaggtaaaaataagctaccatttattcttatagtaataataataataattattattattattatttgagatggagtttcgctctgttgcccgggttggagtacaatggtacaatctcgactcacttcaacctctgcctcccagattcaagcgattctcctgcctcagcctcctgaatagctgggattacaggtgtgcaccacccctcccagttaattttttgtatttttggtagaaacggggtttcaccatgttggtcaggctggtctcgaactcctgacctcagatgatccatccacctcagcctcccaaagtgctgggattacaggcatgagccaccacacctggcccactctttcttttttaattattgagaaatataaaaatatgtcaaaagtaacaggtgtggtggagttacagcatgcacataatgggatacagcccattatctaatctcagatggaaactagaaaaaaaagagaagatctttgctaaagcacagattatgtggaaaatcatttagaaaaatagcttatcacaacattaaaattaaatcctttagctgatcatttttccttgctattttttcttttaaaattgagaagacagtgagttttttttctttattgtcattatcttgatgtcaaaaaataatatgcacattataagtgggaaaaaagataagtcgaaatgaaatgaaacaatgcgaggaaaaaaatgtcacaacactcttcaattagaaaaaatgacccccatctttcctccaaatagaaatgacgtaactgaagtagtggaactttctcttccatggcaactctagagaaggggtagatggcatgggattgtggacagatggacacagaaagaggcctcatttattgttattgttaaaacttttacttctagtaatagtgacacctccttcagcatttctttatcaattgtcaatattttttggatcaccagcatcaccttctatatgtatgtctagaaacctcctgttatgaatttacacttctcagagtcaagacagaaatgctgtgaattgggcgataaataaaataccccccttttattgccttgctttgtctcttaaagaaagatgcctgttgggggactatgagaatgctttgtgcttctggacctcaagggacaaatctataataaaaattatgcatagtgatgagaaatatatataatgcaagtttgtagagatcagttaacttatcttgtctaggcaattatttctaaacaatgatttcaaatcattaactataatatagcccattcataccctccatttttgtcaaatccctgtcaccttcaaggacttggccatcccataggctgctctgcttttaatagaggaagatgctgtaactcttggtaccattgccagttatgaatttatccattaatgaacattgcatttaaggcataggtttatctccttctccaggtatgaacctgcaggattcctacctgaagcttaagggagaataaatccacctgggacaatcaaggacagatcaaccaatcagctcaaagcaggtgtgaattacacagtttatttgagtgacaaggtagctaaagcagggataataaaagaagggagtgggttgatgtggacagacgaactatggctttaggaaatttggtagggactgaaacatattttgtgtaatttatgtgggtctaatagcttttgaaacttgtttacaagacctgtgtaagtggtactggcatattcatgcatgagaaaacatcaagggaaaacttaatagttcaaggaggtgacaaagaagagaggaaccaattattttcactagccgtcaaaagcaagaaaataatcagcttgagcccttcggggaaaagataggttaaatattaagtaacagtttgttattattccaagtgttttcttaaagttgctcccatactttcctgttttctctgagggaatttagtttttttgttggtttttttttttttttttttataactgtcattggtcagagcttgatttgatgccagtcaaatttttttaaagagattatgaaaactgcttaaactcttccaaagggaagatgggtcattcttaacatgtgtttcaagaggaagagcataagagcattatatggtaaggctgaaagcagatatcagcgtttaggggccatgaagaggtagagctcacattggtaggatcattgactagaattccagagatcaaaattgtatgttagtctagcattggggaggacttgtagctagtatcttcattctagcttgggagcctaggaatcaggttaggcatcttgcacaggaatgggccgatgggctaaaatctccttgagagagatgattaatccaggacaaaccaagcagtcatgccaatgaattactttaacagggtacttcatatcctcatcctttgggcagcacggtcttcagagatggggcaggccccaggctgcagttgagattctataaactaaggtcaaaaagatgcagcagtgaagaagtcatgcttatcttgtataaatcatgttttcttttctttttaatgaaaatgtacatttaacacattttaaaactaaatattgaccctaaaattccaaccaaaaaatgctacataagtggtatttatttttgaatttccctcatgctcctcccactgtggggacaaggagtggtggtggaagagagatcttttagcaaacctgtgagtagagaattagaaggtaatgggaggaaggtaaaaggaaaacatcatagatggataggctcacaaacattaaaggccttcgtgcctgtccttcatgcctattcatccctctccagtatgtgaatcaatgtacttgttaaatattcattcacctcacatatttagcattaaccgtgtatcagggacgttgttagaccgttggtttacgatgatgtgtaaaatatcatttgtaactcagactaactggaagtgctcaatataataagatgtaatgttatggaacactaagtctgtgctgaagacttatctcctttaatcctaaaacaatcctggtgggtagtctcaatgatcatctccaagtcacagttgaggaaattaaggcttcaagaagttaagaaactggaccaacatcacaaaggtagcatcagagtgacagtttgatttcaaagtgtacttgacttcaaggcccacatttccttgcacgtttaatattgcctttctcaggtaaatataccattaaatgtgatacaactctaagcatttgaattacttacaacgtgcagagttaaaaccagcattatttacactatacttcagctcgtttataagtgaactattattttgtggactaacctatgaaatgtaaccacattgaattcctctgttaggtacaggtttggtgattccagggaatagagtatgactgaatgcacaggtaggggtgaagtgaacccggtcagaaaatttagagagcatcgagcagatcattaagcagctgtctttcaaatgtgcagaacacaactcatttgtaatctagggactatctgtattgattcttcccagggaagttacttatttttatacatatgtggtgtgttctgtccataataccattctacatggtaatgctcaactttattatttaaaaaaactgctaataatgaggtttttctttgtatcacagaagcagcaggagcaagttttctttttccttcccagtttttttaagtactgccaaggaatgtgattttgtcagacttgtatttcctattaagccaatctgcatgactgttccttctactagctttacctgttcactcatttattaattcatcaaatatttgtagagtgactattgtgtgccacatactaatataggcacaaggataaccaaaaacagacaaacgctgtcctttcaaggagctcatatagtaatgggaagttaggaaaggagaaaataaatatgtggtatttcaaatggaagtattaaagtgttaagaagaaaagagaaactaacaagatagggaaaaagtgacaggaacatgatgttttattttttatttatatatattttttgagacagggtctcattctgttgcctaagctggtgtgcagtgacgtgatcatggctcactgcagccttgacctccctgggctcagatgatcctcccacatcagcctcccaagtagccaggtctacaggcatgtaccacgatacccagctaacacgttttcttttcttatagagacagagtctcactgtgttgcccaggctgttcttgaactccggggctcaagcagtccacccacatctacctcctaaggtgctggaattacaggcatgaaccaccatgcccagccgaaattgatgttttatatatggcagtctgggcagacctctttgatgtgatatttgaacagaaatctcaagagagggagtgtattagcccgttttcataccgctagaaagaactgcccgagattgggtaatttataaaggaaagaggtttaattgactcacagttcaatatggctggggaggcctcaggaaacttaaaatcatggcagaaaatgaaggggaagcgaggcaccttcttcacaaggtggcaggaaggagaagtactgaggaaagggggaagagacccttataaaaccatcagattttgggagaattcactcactatcatgagaacagcatgggggaagccaaccccatgattcaattacctccacatagcctctcctttgacacctggggattatggggattataaggattacaattcaagatgagatttgggtggggacacaaagcccaaacatatcattttgctcctggcccctcccaaatctcatgtccctttcacatttcaaaaccaatcatgccttgacaacagtactccaaagtattaattcatttcagcattaacccaaaagtccaagtccaaagtctcatctgagacaaggcaagtctgttctgcctgtgagcctgtaaaatcaaaagcaagttagttacttcctagataaaatggaagcacaggcactgggtaaatatacccattacaaatgggagaaattagccaaaatgaaggggctacaggccccaagccagtccaaaatctatcagggcagtcaaatcttacagctctgaagttgtctcctttgactccatttctcacatccaggtaacactgatgcaagaggtgggttcccatggtcttggtaagctccacccctgtgggtttgcagggtagagcccctctcctggctgcttttacaggctggcattgagtgtctgcagcttttccaggcacgtggtgcaagctgttgatcgctctaccattgtggggtctggtggacagtggccctcttctcatagctccgctaggcagtgccccagtggggactctgtgttggggctccaaccccacatttcccttccacactgtcctagccgaggttctccatgaggtcttcattcctgcagcagacttctgcctggacatccaggagtttccatacatcctctgaaatctaggcagaggttcccaaacttcaattcttgaattctgtgtatccacagactcaacaccacgtggcagttgccaaagcttgggacttgctccctctgaagcaatggtccgaactgtaccttggccccttttatccatggctggagtggctgggacacaaggcaccaagtcctgatgccgcacacagtggtggggttgggggggggacctggtccacgaaaccatttttgcctcctagacctctgggtctgtgatgggaggagccgcaatgaaggtctctgacttgccctggagacattttccccattgtcttgcctattaacattgggctccttgttaaatatgcaaatttctacagccagcctctccagaaaatgggtttttcttttctactgcattgtcaggttgcaaatttttcaaacttttatgctctgtgacctcttgaatgctttgctgcttagaaatttcttctgtcagataccttaaatcatctctcaagttcaaagttccacagatctctaggtcagggtcaaaatgatgccagtctctttgttagtcatagcaagaatgacctttactccagttaccaataagttcttcatctccatctgagaccacctctgcctggacttcagtgttcgtatcactatcagcattttggtcaaaaccattcaacaagtctctaggaagttccaaacttttccacattttcctgtcttcttctgagcctcctaactgttccaacccctgcctattacccagttctaaagttgcttccacattttcaagtatctttatagcagtacctcactacctcagtaccactggtcttaactcctgcgctcaagcgatctgcttgcctccacccctaaagtgctgaaattacagacatggtccattgtgccgagccaaaattgatattttatgtatgacactctgggcagacctctatgaggtgacatttgaacagaaatctcaaggaaggggagaaattatccatttacatatttggggaaagagcattccaggtagaagaaacagaaaatccgtagtcttgaggaatgccgtgtatatgcagtatttttcaaacttgttattttgaaatacatatacacttacaggaagttgcaaaagtattaagaaagatcatgagtacccttcactcatcttcagctaatggttacatcttacataattatatgtaatatcaaagccaggaaaccaggaaattgatgttgatacaatctatgctttattcagatctcacatcttacatagctatgcacaatataaaaaccaggaaattgatattaacacaatctatgccttattcagatctcaccagcttttacatgcacttatctgtgtctgtcattctatgcaattttataccatgtttagagtcatataacaactacccctattttgatacatggtactgaatagttccagcgtcacaaaggaactatctcaagccaccctttaattgtcacacccatccaatctcccattctacttcctgaatcactagcaacccctaatctgttctccatctctatgattttgtcttttcaagggagttttctaagtaaactcatttggggaaagaaaggagatgaattgttctagccacggagtggagaacagagagtaagagtacctattgaagcagagggagtcattgcaataattcaaatgagaaataatggtgattctaaaccaggaagctttcagtgaaaacaatgagaggtacatggattctgggtatttttggaaggtagcactaccaggtttgctgatgaatggggtatggggtgggaaagaaagagaagagcccaggatgagtccaaggtggataaggtgaatagaattgagaaaatggtagaaggatcaagttagatggtagaggggtaaaggtggaagcaataattttgttttggaattgttaggtttgaaatcttgttagacatcccagtaaagtcacaaagagtgcagttggatgaaagtatgggattcagggaagaagtatgtgctagagatgcagatttgagagtcatctgtgtggaggtattattcaaattcaagtccccttggaatgaatggctattcaggcagggtcttcataaaaatgcttgttgcatgcctgtaatcccagcactttgggagtctgaggtgggtggaacacttgaggtcaggagtttgagaccagcctgatcaacttggtgaacccccatctctactaaaaatacaaaaaaaaaaaaagttagctgggcgttgtggcacatgcctgtaatcccaggtacttgggaggctgaggcaggagaattgagccaagattgtgccattgcattccagcctgggcaacaagagcaaaactccgcctcaaaaaaaaaaaaaaaaaaaaaaaaaagcttgttgcttcaaattcatgtcagtctgtaaaattatctgggaaggcagtacaaaaactgtcactttgactacgatgtttctggtgacccatcttcattgatcagtatggaaaaggcatgtctctgaaaatctctgagagtctttgatacagcaagaacataaggataaatcattcttctatgttcatggttgtagaggatcttgaatgtttaatggcagaatagccagatcacactctggcacttctgtatgagaggctgagggatgttactgattcaccccgagaaatatttactactaaggggacagaggcaaaggggatacaagacttcaccctgagctgtagcgctccctccttccctatcctgctttcattcttcacattgttttccttctttcttttttattattatactttaagttctgggatacacgtgcagaatgtacaggtttgttacataggtatacatttgccacggtggtttgctgcacccatcaacccgtcatctaggttttaagccccacatgcattaggtatttgtcctaatgctctccctcaccttttccctgtgtccacattgttttctttctttttgaagcctctcattcactaggtttcaatcctgccttgctagtgttctaactctaaggcctaggcaagttatttcaccgaacttagcctcagtgtcctcatctgcaaaatggatagttttatgatatcttcagcccttaaagtcaatggttctgacagctagggtgtactatcttcttggatatcagtcatctcaagcaagccctccttttttggaccttcttttcacacacttcacataccttagagaacataatacacatcctctttactcagggcttattctttataacaggcttcctaattcaattaactcaacttttcaaaaatattagtgactactgtgatgtaaataaatttgcattttataggggtcttagtaacccagaagggagtggggaaaattaatatatattgagagtttattaagtgctaggtactgtaaatattttcttgtatttaatcctccgagtaattctacaacaaagatattatcattgctattatgtaaataaaagaacaaagtagaaagaaacccacggtcttgtataagctcccctagttggtgggtattgaagggagtatttcaatctttggtagcttctgagtttttgttctctcagggaatctgccagatgtccagggcacctgccaaaccctatgaggctataagaaaaccattaagggtcttagattacccagctttttgggagttagaattctgaatgaaatttagtgttcctgcagctacaaaggaattgagttagggaagtgatgactttatctttagctacattggttattttccttataataatcctggcttggtagattagaggcagcccgagtaacccagaatcgctaaaatagaagtgcgagctcattgcccgctgtccttcactatgtttgcatataggaagcaagaataaaacaagcataaaataggctaactagcttgtcagagctcttcacaccaagtctttgtgagttccaataagacactgactattattaaaaagacagagactccacataagtaggaatttattgttttccttttcagtcaccaaaggacaatcctctgcataggttagcaaaaaatggtactgatcctataatctctaatattaaagtttagatttggcaagctgtacatcttatgttgttcattaacaaaaaacaatattgattggtatcttgtactataacttgtactgtgggtcaaattccaatacagcaaataccattgcaataacaattctacaaaactacatcaaaaaaacctttcatgtttgagccaacagcctgatagtgctaaggactttgagtacagtatgctagaagattcttaacagttatttgtcctggacaacaaaggttgactccattaaaaacatagccatcagtgtgggattatttccaaatcaagcttttggaaaagtcaaatgaaagtttgcaagcaggtggggcatggtggttcatgcctgtaatctcagcactttgggatgctgaggcaggcggatcacctgaggtcaggagttcgagaccagcctggccaacgtggtaaaacccccatctctactaaaaatacaaaaattagctggcttttgtggtgcatgcttgtaatcccagctactcaggagcctgaggcacgagaatcacttgaactcgggaggcagaggttgcagtgagccgggatcatgccactgcactccagcccacatgacagagtgagaccctgtcttcaaaaaagcaaaaaacaaacacgcaaacaaaaaaaaaaaaaaccaaagttggaatgcaataaatgttcattgaatgaatactgaatagggagtttcagctaatccactcaaaatagtgctgaatttccagctctaaggtcaatgcttggcatatatatcctgaaggaatgaatggacacagagtaattttttttctaaaatgcaaattcaattatgtcacttcccttcttaaaatccttcagtagcttcccgtagcctccagcatattattttgaatagtgcttctcaaactttgatgtgcatcagaatcacctggggattttcttaattaactgatgctgattcagtaggtctggggtattgtctgagattctgcatttctagcaagtgctcagggttatagcaatgattttggcctgcagaccatactttgggtagcaaagacataagccacttaacttgacataaaagactgtttagacccttagtttctctctcgctctttccccattttgagcttttgctccggttcatgtttttccctgaaaataccgtgatcttacattgtctgtctggatgctgaattttccctaattctgggcctccatgtagttttaggtttgacatcacaaccaccaaaagatttccccttctcccttaatcttggttaatgtcactctcatgtattatactgttaatgaagcattgaggacataaaacttatcaaatattttatcacaatcaatgatggcaccagtgataacatccaaatgcctgggtgagtaaataagaggagaataggggacttgttgttaaactaagtttgcagagaaaaaatgtactgattataattaaattggatgtttatttgttatgacaaaaaaggagctagagtcttttaatccaccccttggcaccactgcttatctccttgtaacatacgtttgattcccatgtctatttcttccatatgggaaatttcagctccctaaacatcaccaatacaacctgttgataagacaaagttaaatttattgcttactatggtaagaaagaccacagcctggacaaagctttggtagtatttcataaggagaaaggtgaggttggatttcattgggagtatgaagcttggtttaagattggtctttcactgtgggggcacaattaggattgggtaaggatcatggtattacaacttagtttggtggaaacagcacagtgaagatttctagccaagaggctcagagactattaaggtgtgaactctattgatgttttttgttgaagagttgatgggagtttggggaagttactttagtgaacagtcaaattatttgcctggccaagagttatctgtaataggaaagttatgctaatgaagacaatggaaaggtaaaccatgttaatgtcgacagccagctatgtgagcataaggggtaggtagctttggtcctccatgtccaaactgtttgtagtggtaagtgatcttcattctcacatagattgaaagcttcctgaggacagggcaatgtctttgtaaactttaaaatatctatgtcctgcacatcacctgccgtagacaagcatctagtaattgacggttgggtagatactgagggaaaacatgcaccaaataaaaatggcaataggacacaaattcactatcatttggaagaataacagtgttttccactgatatttgctacacacagtggggtccacagagcagcagtaccacttgggagcttattggaaatggagactctcaggcaccaccgcaggtccaatgaattaaactctgctttttttaaggtcatttgtattcaattattatttttttcttttttctttactttcgatgcatttttctttatttgtttttgagatggggtcttgctattttgccgagtctggtcacaaactcctgagctcaaatgatcctcccacctcagcctcctaagtagctgggatcacagatgtgagccaccacacctggcttgtatcacattaaattttgaggagcagtgctttaatatctattccattctcatcacttgatgaggtattattaattccacttatggatgtggaagttgaagccagaaagtttaaatgacttgtacaaggtcaaacagcttacaggtagttgagccaagaggctctcaagtcttctgcctccacaaacccctgttcagctgctgccctacaatggaataaaatatactaatcccagagggacaaatatgctaaaaatctcaatattatacactttggaaggtgcaggtgcattatctttcaattctaatttctctttcaagttttctgatgcataaaaatatgaacagcaggtctgagcaatgtttagatgccgtgctttgatccttttgccattcaagatgtttgatttgcattctgccaaggaatgtctggtaacctccatgatgcagaccacaccattagtcaagagagagctgacgtaccttcatctgagagctggctggctgtgagctgctcagagggaaaggatttctatttacaaattgtatcgattatttataaataaaagttccccttgctttcttcagttgtaaaatctgcagttagagagtcgggaagaagatcaaaactgcatacatttgcatctgccaagcctgataactagttccagaattacagaaatggtgctgaaatagcacctcaagtaccaggctctatcaaatttaatctatccataaggcaactgccaattatattttagagaaaaaatgtagactgaaaagatagacaatccaagtagcaactcctgtaaaattatatgcccataggagcaatcttgaagatataaatattggtatgtttctccttcatttatcatttatctgatcatttgacaagtatttattgaatgcctgttaagggtgtagatatatgtggtgaggctgcaggtgtaagtaggtctttctgaggatatgcatgaagttgatgttcataacttggagatgtgtgtatacagactgaggattccttcagtggatattaagaagtggagtaataggcagtaaagaatacactagtcagttgtggtacataaacacgtcagcaccacttaggtattaacttcctgttttgttttgtgtgtgcttaattacgctgtttattaaacaagcacatcataatctgcagatattgtcataaacagcacaataaagcctgccacatcagaatgtcatctatcaaattaggtgtgttcctcagctgtcccgataggcacacacctgtgcctgtaaataggcgcttggcggagattgcttccaggtgtggatctgttgggcgaccttgggatgtagggcactttggaaccttttcctctagcttcaggaattaacctctgggcttggttccatgccagcttgcattttgctttgggacagtaacatgtaaagaatatgcctgtgaatttagggttactgagaagtcctcatagaagaagtaaaatttccttgaggaatgggagtcttttattcaatccaggtttaatgcaaggcttggtgaacagctccagaaggttaataattgcgtgcgtgtgtgtgtgtgtgtgtgtgtgtgtgtgtgtgtgtatccttttgtcattcaaaagtatacgtatacacacacacctgtacagctgatgataaatatacattgtatcaatgagttcaaatgaagtgtgctattcattcactgaggaatgggctattataatgaactattatgatattagaaattgtcagggcaataagcaaataatacatacggttttcaacaaactttctaagtattgttatcagtgggtttgcttaaatctttttttacaaatttatttatttttttgagacgaagtctcgctctgtcgccaggctggagtgcagtggtgcaatctcggctcactgcaaccactgcctcccgggttcaaaagattctcctacctcagcctcccgagtagctgagattacaggtgtgcgtcaccatgcccatctaatttttgtatttttagtagagacgggttttcaccatgttggccaggacagtctcgatctcttgaccttgtgatccatctgcctcagcctcccaaagtgctgggtttacaggcgtgagccaccgtgcccaggcaatagccccattgctcagtgaatgaatagcacactttattttaactcattgatataatgtatatttatcatcagctatacaggtgtgtgtgtgtgtgtgtgtgtgtgtgtgtgtgtgtgtgtgtgttgaatgacaaaaggatacacacacacactcttattaaccctctggagctgttcagcaaaccttgcattttttactttcattacagtgtgtaaataatttagcaaattctaatttgaacctgatatcaattgagcatttaatatttagccaaatatttatcaagtgctgactgtgttctagatgctggggctgcaatttcgaaacagaccattgaggccctcatggagctcacaataaatgatcttccttaaagtatcaggtctctggtttgttaccgtattttttaaattgttaaggaaagaaaaaggccctatctttttgtagacaaacatgccctaagtgcttccagaaataatctccatcaggtaatgcagactgtgtgtggagtgaaattgagtccaatccatgatccagcagagtttcagcccaggatttctttagagcctttgctacacacaaagttggctgatgtgccattcagcatcccagcagctctttctcttcacactagcaatggcaaagctttgtgcggaggcattgctggctgctctgaactaaaagcatccgtggggaccgaaagaggtttttgcacaccttattaaggtaggcaagtgtgtctgagtgtgtgtgtgcctaaaagctggaagacatctgttgagaggaaagtgctcttctgtgggtctggcagcttttctgtaagtcttctattctgatgcaggagcgtgtgagcagtgggtgggaggagatgctttggtacttggaatgctgaggtccggattaagtggtattgtaatagctagttagaggcagaataaaaagctgggaatcaaagcatttaaaaatgcatccttccattatttgctctcaagttaaaccatattcattctaggggaaattaaaaaaaaaaaaaaaacacagcaagggcaagtagcccaaatctgtaaggtctttgagcttctctgttcgtccagcttttgaagtcttcctacagccaatttgtttggctcctctggagggggcaattcatatccacttccctctcctggagcatttctttcttctatactccatcagggaacaatagagtttaacagtaacaggcaattttttttttttttcaaagcttgtgccctcttctgcgtttaaaggtgttttttaagagactcctgctaggggaatcttggcgcctgtgtgttaagacggcaattaacttttagtatcagtgcttacattaaattttctctctttctgctttactaaagcagtcattaaaattcagtgtgagtaccatgaaactttatcataaaaccctgctttgcttagagaaccttgattgttttctgaaagcagccttctcagtttatatatacatagctgccttccttggaatatcaaattgctttgtgtcacattaagaaacactaggttgaacctctatactgtgttttatctgagaaaaatactactgcaaaaagtttgatttgttcaagttttaggatgaaaatttctttgtaacaagttatttgagttgcatactatgtcatcgtatatctctttagttcaagtaattttgcaattaacatacggttatgtaaagaagataatgatttattttttatttatatttttaaaagttattaagtgaggttttcctttcagtaagagtttagaaaaaatagccagaacaagtaactggacttggaagataaagatacctttgcacttctaaattttacctttgtacacttcggttgtgatttaatcattgaaatgcctctgctttgaagtaaatgcatcacttatggtgtatgctgtgttttaataaagggaaaacagttatgggttctctgttgcacatttgaatgttgttattttttgctgtatttaataacctcttttttctcttgtgaggtttactttggaaatgaggcatgttcaaaaataggctgacattcagcttctatgttttaaatttaaatgctgtctgtgttttatcacatctggaatgtgtggggagaaaagataccaagttttattatttagatttaattgtagaattgcagattgatatttttcaatgcattttcattatagtttctgccatggaggcagcgtgagggctttcaggaagatggagtggtgtaattaccaggtgcgcacgttcattaatccttcctggctagagaaagcttcaagttcttctccagtggcccattcgtaaagctataaatatctaaattgtgtcagccaagaagtcacacagaatggtggctctttttgagttcaatttcatgcactgttgctttggtcttgtgaggaaagctctgaattccttaggatagtcttggttgtgaagttccaaaaacaaaatatcaaatcattaaggatttaatttaaaatacatactcttctttcacaaactagatgattgcagtaatgtggattataaatttttttttttgctttatttctttagagctcctctttttattttgtatgatcaagattatagctgagattttggtgatttttttaaaaagatttatggcttatggtccatcagtctctccactacttcaaacctgtgtacccctgtatattatctgcagtactggaatgtttgcattgtatgtggaagctatatacgatttggtaaaaaataacacttaaaggtcttcgctaagagtgcttatttaatcattaaatatcccttaataaaaataattccagagatattgtctgtgtacaaacttaaaaaaagagaaatataaaatactgtgatgtgaataaaatgtatagcaatacactccaataataccattcttatgttttcccttgttctcaactgaaataactaagctaatagagacgtcagtaaggaatgtgttgtttcttcataatacaactacaaactcatctgataagaacaacctgagagtgaacgttaactttcctcattagaaagattcaatttaacacatatatacaaatacatttttaagataatgatatttgcagagtttttgtattctatggagtaaaggagaattatcacatattcaaagtaaaggtataaaatacatcttaatgttttacttaaattttaaagggtccaaaatatactaaaattgtttttctaattctttcctatgtttaaacgtgccagagtcattggaaataggacattctttttcttaagaagattttgcccaaaatatttaaaactattttcttttcccttgattttacaatttcaatattcatggatttttctactttaaaaataacagtagtttttatgatcttaaaacaaatgtttaagggcactttcgctctctggagactataccatccacatatttattatcagcaaaagaaagggcagggcatacttttatttgaagttgagtataaaaatgtgtctgtgtgtgagtgttattaaaaagataagtgaagagacaaatatagaatccaggaacattttcagcctggcttttactctctctaaaaatctaatgaaacccttgagcatctcttatctcaaggtacattaggaactgtccaacactatgatccgatgggagatcagtatattcatataaagaagaaaatttgttgttagtgaaagtcaagtcttttaaaaaaataatagttacagcatttgcaatatacaagcataatagatttactcaacgcccaccccccatctttaaaaaatcaatttccgacagttgtctactttaaaattgaacatatttgctacctggagggaacattgtaatgtagcccatatgtggtatgcatcctgaagaaaacctgaaattatagaggaagttatcctgccttctttcttctgttgaatgagttaaaatatattaacaatttgcctttcactttgtatttatcattttgtatctttgcatatttacatatacattcatgtgtacaagggcatatatactcacaggtcagggctatttaaacagctatttatttgaatatgccagggaaaatctccaagatataaagaagcagttattagatactatgtcagtatagaattaacagccatcttttttaagatggaagagaaaattaattaattacatacaatttctaacctcaagacattttctttctggagacaaggaatactgaggtgctcacgatagtgaagactcaacaagaccctaataaaatagatgaggataagtaaaactacaatagccaataaaaaacaaaaaacaataaaccatgtttcgctggcatgttggtgagtatctctgtaatatctgtcaataagggtctctgtagatttggagtaatgttcaggaactacctgtactagagaagacagtggagaggactccagtggctaaattctgctgcctttgcttccagaaatgtaaataataaggaggtattgtggcatttcctggaagcagtagtcttgtttcatggtctgactgtataagaatgcctagagaaacataacctcagctgactaaactcccttgatgattgtcactttgtcactgaactctgaccataccttttgcctccagaggcaaaagacgggtgaggaagtgatctcctcatctggtttttaaacaagtatataactagagaactggattatctcctaaacccactcttgtccctggaaaaaggggagtcatcctatccgtttcttagccaatttatgtatactcttagtttgagagcatgagaaggaaaactattttcttttcttaccttggctgggtttttaagaatttatttttagtttaatcaaaataatattttaaaaggtagtaagcctctcataagcagtttgatctgttctaaaataacttcaatttttctttttttaaactttcttttatcttacacacaaagtataatagtaatatgtactcactagaacaaatgaaacaggatggagtcacatagagaaatatatcatattctccctatcccctcccttaatattaacatttaggtgtcatgtgcttctccattaattttcattgcaaaggcctaaattttcttccaagagtgaggagtagcagcacggtagtttggacctgatatagctctctttccctagccttttgcttaagtgctttcctaggggctgactttacttacctaaagatgtttcaagcaagggctcacatttttggtagcagaagacacttactgattgctctcactaataattttgaaaggaatgtcaaaatctgggaggatcatgaaagaaatatcagaaatttcctttcagctgccattctccttaatactgttatcaataaattcagcatctcatatgtgatagcaaaaaaggtgctgccttttgttcttgcatcctgaggttcttacctaataccatggtagcaataaagatggtgagaaaattgcttcttctatggtgttcaggtcctgaacgagcaccctcacctccacagacggtggcaggtattcaagcattttacagactttggagttaaatatagcagtgttattctaatttaggtatgccaccaccagcggcaccggcaactgcaataggaaaaatgattggcaatgccagctatctgatgttttcatgtgccaggtgctgtcagttcttcacagtattacattccatcctcacaacaagagagtgccagtgagtgttgctgtgtgccagtgcccaggctaagggctttgaacacattaccctgttttatcctcataactttccacgttatttttattcctgaatgaagaaacaagttctctgtagagatgctgtcattgatccactcatatcctttcacatccgtttaacattttccctgctgtgcttttactcccaacaactagctccctaatcgctctgttggagggtggccttgaggctgccagagcctatttggtctgtgtaaagagagagatggatctatcctggaatttatgtccctgtgtgtgggaagcccttaatcaatgactgctggttgcagacacataaatacgtgagctttcttgttcccaactgagaaattcagaagtgtgaatggcactgccaccctgggcttttatgccatatatgtgtttggtctgtttcccttcccaatctcacttcattttcccttaccagtgtttcttgaaaacacatcccattagatcatttttgcatgaagcttcatctcagaacctccatttagggaacccaaactaagatattctctaaaatagaaactttattgataaagtttccaaactgtcttagtagatggccaatataagaccaagccaaatctttctgggtccaaattccctgtctttaattaatagactccattacaacacattcttcaatctttagtcagcaaacacttaccacgtgcctattttatggcatattatatttataccatagttaggatattatggttcatgaatattttatatctgtacacctgaaattctattgacctctctgggccacagttttgcatctgtaaaatcagcacaataatgctacttatctcatagagtagacttaaaaacgaatgaaatgatatatgccaagtgttgagaatcacaattggcaattactcatgctcattaaatattagctgtttttatgagtattgtttcattttcggtgcataatatcctatgcaaagaacaaaaggtattggtataggcattgaaacttgaagcatagaagaaaaagttaattaaccggtgccccactagatgcctctaactgctggctccgtgtatccctttagccttggctcgtcacgagaaaaccttggagacatttctgctggactcagcagatcaatttaagaaagatgaatgacatttttcttgaaatgtattcagtcatagctgcctttttctactttcatattttggagttcttagaaaaaattaaggactcctttttttaaagaaaatggtataaaagaaaatgcatatcactttgtcactttattattgtaacctcatcaaagtattcagtgtaaagacagtagccaagtgaactcttcttgtaatgctcggaaaccattttagcaatggtaaaattgctgcaatttatattcgtcaaattgcatgatttgacttattttagaaaagttattaacttctgaagagaatgcttcagaagcatttaaatgagtacaagttatcaccagtgatatacataaatttcatttcaaaatatacttctagaaactgtacttagttagctatagtatttgtacaaggattaattcctatttcattttgtaggaatttatttatgaatgtctatggcctgccagtgtaaagcagacttagagcatcatcttttacaataatctttttttttttaatcaaaggggagatattctggtaaaacaaaacaaaacaaaaacaatagtttattctgcatttttattaagtccctctgtaagtcatccctgaaatgggatatgtagagtcttatatttatttatttctcagaagcttattggaggtgatatgaaggattttaagaccctactaactaacaaaacaacaatttaaaattaattttcaaaataccttaacaaatcttattctccttattttcaaattctttaacaatgtttttcttattactaacataatatcttctgatgtagtcataataatatctaaaatgacaggtctaagtaacttacatggattaattgagtcttctaaatagtaaggtagatggcactattacttctatatgagaaatgaggaagtagaggtataaataagaaattttttggccgggtgcggtggctcacgcctgtaatcccagcactttgggaggccgaggcgggctgatcacgaggtcaggagatcgagaccatcctggcgaacacggtgaaaccccgtctctactaaaaatataaaaaattagcctggcgtggtagtgggtgcctgtagtcccagctactcgggaggctgaggcaggagaatggcgtgaacccgggaggtggaggttgcagtgagccgagatcgcgccactgcactccagcctgggtgacagagcgagactccatctcaaaaaaaaaaaaaaaaaagaagaaatttttttgagtgtatacagttagaaaatggcaaaatgggaattcagacccaaacagtaagactcaaggatacctttcttatcagtatgctaatatgaaaacctaagcatactagaaaatctaagtgccagttggaaaccagaattaacattttggtgtgtaactttctggctgctttttctatgctaacaaacatatatgacatacaaaaatacacacatacacaaattcctgttcactacttcttttatgttaacatcacaatgtaccgtacacagctgtattattttatatttgatttcatattttttctaaagtcagtgtatttgtcaaatatcaacttatctatttaataggaatatgggatgatctttgcttatacatacatacatatgtatataaaaacaaaatcaagtattttaagcgttcaccagaagtcatatgtcaatcagtaaagtatataattttttgctgccaatgacatatatcataaaaacgctacctatcatagaatgaaaatgaaacacagcaatattgggacacctattctcaagcaacagctttgtgatttattagctatctcacatgaaataactcattaacttggtattccaagcagcaaaagaaggatcacttaggtcacttgcaaaataatacaaagctaggtttaggggtgggttgcgcttggtgggatgtagatgaaaccatatgggcccttgagtttataattgctgggatctgcatggtgggtatatggatgtttattacagtatgctagtgagttaagaaagaagaggaattattattgacttacatcatagagtttatgcaaaaattaaacgataatttatttttaaactctagaggtataggtaccatcatgaagggacccacagaactgatgtagccagtaattattggagctggaacagatactctgctgtcagttgttctggttttgtggtcattgttcttgcctttgcaagttaccaactctaagaccttgggcaatactttaagtcttggttgtctcatctgtaaaatggggagagcagtaagtgtcttaaaggtttattctcatgttatatgacttacggtatgtaaaacatctgcgtttagacacatagagggtgcttaatggatgattgctctcattattaggctacatctaatctatgaatttaaaaactgtatagaaatatgtgacagattctttaagagccaaataccaactacagtgaaaaatacttaacacttgctgagctcttagtatgtgtcaggcttaactaccttaatgctcatagcaatcctataagataggtactcttgttatcctattttatatcttctaaaattgaagcaagggaagttaaataataggacaaagatcatacgctatctatccatatatacccatctggctgtctacctgtctccttccatccatccatccacttattcatctacccatccatccactcagttacttctctctctcccaccatccctttccctttccctctccctctccctgtctctgtcactctcctttacttatctatctatcgatggatcggtttatctatcatctatctatctctatcatctatgtatagttgttaataacactaacattttataaattacaagactgaaaaatgttttcattaacttatggtaacaaaagaccacattgtgaataaaaaaagcagtaaacacaggtctctgcacatatgaaagagatgtcctaaacaggaagagatgtcctaaacagtagggatacatagtatcatacaatcaaaacatggcagccctataaaacttacaaagcaatttcatgtaagttatttcatttgactcttaccacaatctatgaggttactatttttatttttctcattttacaggttaaatttaatatggcttccaataaaaaattagtatggttaataaatatcttgacgtcttgctcctataatcctaccgatagtttacagtaattagtaaaataaaataataggaaaaatacctttgatactagtattaaattataatcatatcattaggtaatttcaatttgtgattttcaagaatctgtaatatggtagcttcttcctactgacatgtttgaattcattttaaggcttataattcacaagtaatctatatattatctaaaatgtaaatgcacattcacatggagataataaattagcgtgaaatggctgtattttgctctctataatttttaacatacaggaaatcactgttgtctcaaaaatcaaggaaatatagtatttgaggtgaacttattctttctactattaacacattttaatatagttctctcacagtgcaacagagcaagaagctttcagacacatttgctgctgcaaggagcatgctgtgctgaacttaaaacaccttccctttcaaactccttgggactgtttttttccaagagacttcaaatgcactaaatttagcatccgttggaggcacacccaggcatattatagtgaaagccccaataactgaatgtgttaccactattcacaatgtttatgtgtgtatatgccttatctatgatgtattgcaaattacaaaaattgtgttattattcacagtaacaaaaacacttccagcaaatttctaacagtgatctcttttgaaataacttacatacatgtgtcatgggtcttaaactttgtcacttttatgtttccatcatgttgttttagccagtgagggttttgtttggttttcatttatgattatatactttcaaaaaatagatttcaaagtgtgaatttgattgattgattgactgattcattgagacggtgtttcactcttgttgcccaggctggggtgcaatggtgcgatctcggctcaccacaacctctaccacccaggttcaagcgattctcctgcctcagcctccctagtagctgggattacagatgtgcaccaccacgcctggctaattttttgtatttttagtagagacaggggttcaccatgttggccaggctggtctcgaactcctgacctcaggtgatccaccctcctcagcttcccaaagcactggaattccagacgtgagccaccgcgcccagcccgtgaattttatttttgaaagacaagaatgtccttgcctaattgcataatagtttaacatcatgaagactaaatatgctttttagccatgacaattttatttattattgttttcatttttaattttctcaaagatcctcatcagtgtactctttttggtcttccttataagcgtattttaacaggacataataataagataaatcccaactttttaaagttgtatccgtatgtattactttaaagtgctattaatataaacgaattagaggcaacttttattcaatcagattttaagtaattttaccaaaaatatggccttgataatgtctctgtaacaggttctctgtaatatacatgctgaggattggtttgtctttgcttttgatactattttaattagaaaagtaatggggaatccagacccttctcatttaataatccagagaaaaatcagtccatgttctaatagtttaaatttttctactaaaacccatgtgagaatccatatgagtggaatggagaggagttcagcttcaaagttggcagatttgagatgattctatggcaacagaaatgtgcttgagggaaatcagttgcggcatcttctataattgtgtcacctagattttgccttaggaatttctagatttccatagaacattgtgacctcaaatgctttatcttaataaagaaataaaagcagattagaagaattatttgcctacagtttgtgggagatgggcaagtcttaagagtttattaggtacccagaacgaaacatattttcttgggcctcataatcacattgaaatacaaggatttagttatacacagtgaccagttagtgaatgacagtcttcagtatctagtagacagtaaacatataaagatgtatttgtggccgggcacggtggctcacgcctgtaatcccagcactttgggaggccgaggcgggcggatcacgaggtcaggagaccgagaccatcctggctaacacggtgaaacctcgtctctactaaaaaatacaaaaaaaaaaaaattagccatgcgtggtggcgggcgcctgtggtcccagctactcgggaggttaaggcaggagaatggcgtgaacccgggaggcggagcttgcagtgagcagaggtcaggccactgcactccagcctgggcgacagagggagactccatctcaaaaagaaaaaaaaaaaaaatgtatttttacttttaactacagcgagagaccctggcagcctacagcatacaattagtgttcattatttagattgcatggatttaatgtgaggggtcaattacttgtctaaccagtgagcctagcctcttgctcaatactgcctgcttcatgagggtgaactgtgctggagaaatatattacaggattatctgcagattttttttaaatgagtggttaagtcaaaagttcttgtgaaaattcagagtaataaattattatgaagttgtgtaactaggtaaaggatagtttcttttacacgggtaaagattaacatgaggaggaaaactttagcaatggcatttaattccattcaatatatttatattgagctcctttaaaaatacagggccttgtggtgggtgctgaggacagaacaaaaaccaagtaatacatgaacataacccttgatttcatgatctagtagacctataaaagttgtcgatatctgatgaaaagaaaatggtaaagatattccaaacagtgtatgcaaatccagagataggatggaggggctctacctgaaggatgatgataagaaaaccgtgttgagtgaagggtgatttgtggaattcagataaaatatcagtcttgaatgctgagtgaatactcaatgattgactagatcccatggacagtaatttcttcaattatgacgatgctagtgtttatgactataactatcattctccatgccaggcactttgccatttggtaaatgtatagtgtgctattctaacaagcatgcacagagcttttactttaatgtatccatgagtttattggggttcagaatttaggtaagctttgcaaggtcgtagcatggagtaaaatatctgaaattcagacccatatctaactaagttcaaagactgtacagatatttctcctcctttgtgcagagaaggataggaatggttccatattatcatggacttagtcagatgttttaaaattataatgtcctgtgttaatgaagaagggatgatattcagtgcatattcttaaccgttactttgcttaatgctctcgacttttctgtgagatggatagtgtagataaaatccccaaggggactcagcaagtgcaagtaaaacaatgaaactttaaagccctttgtcaaaacctctctttttctcagaggatggaagggccgtaaaggttggtgaggaaggatggaccatttcctatgtagtcttctgacaatattcaaacaaaaggagagtcagcaaatcccccttgatgtgggaagttttaatacaatttgcagagtgtctctctggagtagacatcctcctctgcaatcgtgtcttctatatagcctcagggctttgggtaggtaatcctctccaaggagagtcctggagagggctgtctaccccccttgcaccatcctctaacattattctatagctcagctccttgtttctgtttcctgccttgtttttgtctgagtctgcaattatgatgtaagcaccatgaaggaaggtatgttgccagtgtttgcatcagcatatcccccgtgtgtagcagcgcaagggatatagtgagccctcaatgtctatttgtagaaaaaagaatgaacgtatcaacgaaatctgatacatattcattgtgtctgttatctccatctctcttgtcctgccttgttatcttgccattttcacaaaaggccccaaggcccatcatttcttgtgtaacttccagagtgttaatttttaaattaaaattaaggctttctacatgagtgtctattatttgagaaaccatgcaagatcgtgtgtgtgtgtgtgtgtgtgtgtgtgtgtgtgtgtgtgtgtgtgttgcactctatattatattgaattctggattttttcttataaataaaattttaaaaatagttctttaaaaataggaataagatgttttaggaggcacagagagcaaaggagaataaaaattgcaggtttggggttgtgcatactaattgccattgagtaaagagagcacactgaggccatttagaagagaattaacgtgttttgtttttgtttttgtttttgtttttgtttttgtttttgttttgagacggagtctcgctctgtcacccaggctgaagtgcagtggtatgatctcggctcactgcaacctccacctcccgggttcaagtgattcttgtgcctcggcctcccaagcagctgggattagaggcgcccacaaccacgccaggctatttgttttttttttttgtatttttagtagagacggggtttcaccatgttggccaggctggtctcgaactcctagcctcaagtcatccacccgactcagcctcccaaagtgttgggattataggtgtgatccactgcacctgaccttatttttattcatttaaaaatattaaatgttactgcatagggagtaatgggcttaacaatgaggtgaccaaaactcctatgtaccatgcagagcaatgtatcaaatgtttttaactataaacttctcaaaaacataaacctaattgttctgcagctgcaggttatatctgccttgtttgagcaaaatttggtggtgaaaatgccttgcttccatttttccttcaataactgatatggtttggctgtgtccccacccaaatctcatcttgaattctactcccataattcctacttgttgtgggagggatccagtgggaggtcatttgaatcatgggggcggtttcccccatactgttctcatggtactgaataagtctcacgagatctgttggttttatcaggggtttctgctcttgcgtctccacattttctcttctgcttccatgtaagaagtgcctttcacctcccaccatgattctgaggcctccccagtcatgtggaactataagttcaattaaactactttttcttcccagtctcaagtatgtctttatcacagcatgaaaacggactaatacaataacctatataattttgaaaagtacttgtctaatagactttcacaatagaaactatatccttatcaactttgaaaagtcattgcttaatgcctttggataactgaattttctaagattattttaattttgaaagttaaattttatcccagtgttgacgatttttgtatgctacttttaaaatattttgtcagtgatttatatctatggtgcaatcttgtaaaaaattaacaatgcaaatgtggctagaccatttaaaaatcaatatgttataattcagcccatttaatcactttagttaaacatcttaggaacaactcagttccatttgagagaagacacagttttctagatgtgtgttgtggcatcatattgctttacaatatcttacataaggtgaattcaaatcatatcattgaatctgttttaaattctgtcatagcttaagattagtgactaaatattggcaggtttatggaagtaggatgtaaacaagacaaaaacaagggtggaacaagtaattttagtatattattcacttgcacagagaaaagtcattcacaccttcttcagctttgtgaagaaaatagactaaaatcctgttgatatagcaactatgttttccgtttcttgtataaaaataaagaaaacttcctattaggaattagccagacattttaattttctctcttctttctctattttcccttacagtctctttgaaggcaggcaaaatttctataaagttttaagaatgttttaagatttttttattgtgaaatattcatagactcacaaggagttgcaaaaacagtacagagatttcctgtgtatacataacccaactttccccagttacatattaaccaaatacagtatattaccaaacccaataaactgacattggcacagtgcaatcaactagactgtagaccttacttggatttcacctgtttttgcacatgctcttttactgtgagtcattatctgttattctatgacattaaccatgtctatagatttatatagttactaccactatcaagataaagaagtgtttcatcaccacaaagtaacttaaaggattatttttataaagtaatgacaaatgtgtcaaaagccattcctgtgttatatagcaagtatgttttgagttattaaaactcactgatcatgtctttcagtgtcataactttgggtttccctccctaactataataatcctgatgaattacagttgatgaatatgagaatatccaactcttcctgactctataaatatattgactgagattgtaatatttatggtgtcttaaggggcgcttgttttattatgatgatgtgaacatgttgagaatagtaagaacagcccagtttagcaaacaggatatgagtcttctatatccagctcaatcgttgccccaacaggggacatctgcctttgctacttaattttccattctggaaaatgtgaagtgtatgagaatgaataatcgtctccgattttccagcacataataatctgaggagagcaggtacagcaatttaggagctgttttcttttggtttccaaaaaaagttccgtccagtggtctaagttagtcgtttactaagtgatagagcaattggctatgctttttgaacggactgataattatgtggatgcagcaaataggatatagacaatgcatctactccattacagtaaaaaagactctgatagcagttaatccacataccaggcacttagcttaggcacagttggaggaaatggaatggtaatagactgtagtatggcatgacaggagctgtagcttgagattcagaattccaactctgcctctcaatatttgagtcctcatggccaagatatgtaaagtgctctgtgcaggtcttggcaaccatccaccacacacttagtatgcaatatctatctttattagtcaaggatctggaaagctagttgatgagacaaatgatagaaacaagagttcattagatgaaataaagtaataaatgatgcaagaatttaaaaaagatttagagaaggaaagggaacagaactcacatgcaagtagagcaactgtgtatcagataatgtgctagctgagttagaaaccatgtctcatattaccctgaaaataattctgcaaagctgtaggtgttatttttttcatttgacaggtgaattcatgaaggcttgaatatagggttaagtgagttgtttcaatgtagttattgattcaaatcaagatctgaatgactctaaatatggtgctatagagatttgaagtaggataaataggatttgaaaaaaagaaaaaatatatagggaaaggaattggtacactgtagcagtgtcataaatgaagcttcagttgtgtgattccagatgatgtatgtgaggcctaatcaaacagctttgtggaatcaaaatttctgctcttgtctccaactggggacgagttggctcgggattaaggtgggcgaccttgggaagactagagtctaagcaggactttagtccctcataagaattatatgaggatgtatatttgcatacaaattcctgggcccaccgagatctgccaaattggaatgtgtggtgatatcacccagggaaacatagagagctgttataattagtcatgaaatatttagtactgaaattatagattatgttaaataatcacttataggggacatagcagggttggcaggttaaccatacagcaaacagggttgtaagtcagggcctagagaattttcaagaggcaggaattctgcagaatgaaggcctggtctcatgcagcaccatggacagctccgaggcactcttgtttctccaaaaacctgaaatcaaaaactttgcttttcatcatgcaacatacccatgtaacaatcctgcataggtactccctagtccaaaattaaagttgaaaaaaaaaactatactttcatttgaatacagttctcttcggctttaccagctctactctggaaggaatatcttttactcaatgaaaggccatcccctgttaatgcctggccaggttctccttatcagtcattcactatctttgtgtgtgagtgactaaacatataatgctatgtttagtggatggagtaagattacctttgcagaggttgtactggcttacccctttggttcttgtagttttcttctattagagttttttccatccctaggtttctatactgttcaaatgggtttaagattcttgaaggtattcctctgaccttgtaatttatgcttgtctcctagcacaacttttttttgtaaaggaggcaccaactatgtggtttgctggcgatggcatacacaaatcaggtgggaggaattaatgagagcagcaattccaatatctggttcttcaagattaacttgtatagtttaattcagcattctaaataagcctcatagatttaaaaatctagaataaacccacatttttaaaaaaagttttatgttatctgtgctgataatgcacgctgtacataataaaatattattttcttttttttaaatttattattatactttaagttttagggcacatgtgcacaatgtgcaggttagttacatatgtatacatgtgccatgctggtgcgctgcacccactaactcgtcatctagcttaaggtaaatctcccaatgctatccctcccccttccccccaccccacagcagtccccagagtgtgatattccccttcctgtgtccatgtgttctcattgttcaattcccaatattattttctaagtggcagtggaagaaacatggaaagttctacttcatccatcggtggattagaatttgtataccatgagatgattaattttcaaaaccagtttgaatctcacaaaataatgaccctgttttttgaaggacaaggcagaacaaggaactaggctgtgccacgttcaagtcacaatctctaacatttgttttgttttgttttgttttgttttgttttgttttgttttgtttaatctctgttgcttgttcactttctcttgtaatctgcattgatttgctacctggctatttgtagattgacttcggctgccaggaatggaatgtttttcataaaggaacatatgccttaatgaaagtaccataagaagggagtagagtgtgaccaattgcctaggtaataagtagtgacaacaatgatattattctagtataaatggaatcagtttttctttgcccagggggcatgataaagaaggcctggctggtatatactaggtgggacacaccaacagtgcctagaatgtcaatggatcaaacctgagggaaccagaagttgaaaagacatatcccaaaagaaagcatttgatgtttaagggttggcttacttagaacacaatgaaaaatattactaaaattaaaactatgattttagctatttttaaatatgacaaattaaatagcagaacattttaataaaacattacttaaggtccacaattttctgtaagtctaatacatgggtcattaaaataaaaaattccccatgatttatggaatcagatttttttaatacaacgaattctaaatggttttataatgccaattccaattaatatcctaattataacatgtcatccagaagggttaatgactaaattttattaatatttgttttctatttattttgatttgtgcagtttatgtgtatagtaacgatagctgcaaattagataccattagcattaaataaggtatatattttaatagaaaattaaagttaagtatttgagctagcctaaaatattcaacaacttaaatttgttttttgtggatcacatttttttgagacaaagtcttgctctgctgcccaggcttgagtgcagtggtgcattcatggctcactgcctcaaccatccaggctcaggtgatcctcccacctcagcctcccgggtagctgaggctactggcgcacgccaccatgcccagctaattttttgtatttttttttagagatggtgtttcaccatctggtctcaaactcctgagctcaagcaatctgcccaccttggcctcccaaaatgccgagattacaggcgtgatccagtgcactcacccctgtgaaccaccattaaatagctaataaaagatgcatgtcaataaaaataaacaacttactagaatgattatgtgaaaatcatttattcttccaaagcatgaattttcaaacacaccttttgttactgttttaagaagggaatcatttccatatatttgcatgtaaatcacttttagtctcagagaactttccataaaagtttttttattactgctgtaaccgatagagctagtggactattaatttaaaaagctgtacataaaaacacatctatagctcaaataatctaggataccttttagtttggggaaatgtagatgaaaatgaagtaattacagaatccttgttaattttcagatttagacagtctaggcaatatctttcaggaatgaagagatatgtgttttttggcatcttggtagagtatattcccattgtaattcttttgtgaagtctagaccagatgtggccataaaaatagacccctactacaataatatatttcatagataatccaataaagtcaaatcttattgcagtaggcttagaactctgtttgcacccatggaatttatatcagtttttggcaaatcctttcatctctgaggatactttttcatctcacatataccctattttctgaacattttgccttcaaagtatacctcatttatcaagaatttctctttattcatctgacttatacaagtggcaataacaacgtctggttcccatgaagtaaccagtgaccctttgaaataatatagcgctggaagaaagaaaaggaaagggagactgatcattcagcaactctttaaaaccatgtcaccgttaaacacatagtttattttatcttttttttagaattgtgaaaacctatattagcatcttcacggatgtctcctttgtttacatccccgcttctgtgccttgcctgcagtagaaaaaaaaaggacatgtgtatccctattccccattgtcttctcattctacatgagaatgagaattcttttaatttcttctctatctacatgaacccacttccattatctgtttgttcagttctttaaatgccctgaagctagctctgtgactgggcagttgaaagttctggacttagcatcaggttaatttgaaaaatacttattgagccaccaccatatgtcagccactactgtagatgttttgaatgtgtcagtgaacaaagcagaaaagatgtatgccctctggattcttgggggtctcaaatagtgaaagacagatacgataagtatattgtatagtatgttcaaaagtgataagtgctgtgaaaaaaaagaagaagggtaaaataagagatggctcatgctggagtacattccaattttaaatagggtatcatggtattcttcattgagaaggtgacatttgagcaaagatctcaaagaatgaggcatggggttgaatcatgtagatatcagcagtaaactcattttgggttcagtaaacagtcaatgcagaattcctaagccatcggtttatctgctgtttggggctggttatctgcagtgtggctagagtgaagtaagtgagagaggtttaggagagaatgttagtgaggtgagggtggacctttgaagccattgtaaggacgtttttctctttctaagtgtgagaagatgatgctgactgagaccagggtgataagaaatagtcatattctgaacgtgtttggaagtggggccaacaaggatttctggatgaattggataaggggcatgggagaaaaatggagtcatgaatggctccaacgtttttgctctgattaactggaagggataaagttgccctaaactgaaataataaagactatagatagaatggggcgattagggaggcattaaatttggatatctgttagacatatcaccagatatattgaataggcaattgaataaatacctttagagttcagcaaaaaaggtccaggttggacgtttaaatttcggaggtgtttgtataagataacatttaaagctgtgatatcagattgtatcactaaggaagaatatagatagaaatgacaacgtgactaaggactctaacattaagaggtggattgacaaaggagaaaacagcacaggataatgaaaaggaatgatcagccaggcatggtggctcacacctgtaatcctagtactttgggaggccgaggcgggcagatcacgaggtcaggagttggagaccagcctggccaacatggtgaaaccccatctctactaaaaatacaaaattagctgggtgtggtggcacacacctgtagtcccagctgctctggaggctgaggcagaagaattgcttgtacctaggagacagaggttgcagtgagccaaaagattgtgccactgcgctccaacctgggcgatggagcgagacttcatctaaaaaaaaaaaaaaaaaaaaaaaaaaaaaaaagaaaagaaaaggagtgatcaatgagatgggaagaaaaacaaaagtgtgtggtgtcctcaaaaactgacgttctattttcaaaacctacattttgggtctccttttactatatcctgactttctagctatataaccaaaaggagaaagcagtaatttttttagatataacatgttaataactctaagggtattcaatgaatctgaataattcagtggtataatgtgaaaaaatatagtattcataggaaaaggaacagaagttagctcaggaaatgacttgaatgaacaccgaagccaaatctccagcgcaggtccacgtattatttgtctcagtggttgaattagcagcaagattccttagtaggatgaaaaaagatgttgtgagcatctgtatctacatgactgaattaaattcctccaacaatgaaatgtagttaacgtagtatctcgaaaagaaccctaagtggaattcagggaacctaaattccaaccatggttttgctgctgactgattgcattcacttcaaatctatcattaacctccttgtgcctcattatcctcatttcaccaaataagaaaaatgaaatattcctccttccctacctcactaggatgttgtggatttaaatgtgtgagaagtgcttgagatgcataaaatttgatggagtgttttattcatgaattcaaggcatctgaagtaatttgaccatgatggacagttgcttccttgcacattttttagagtgacatttccgttactgacccacccatttatgcaacatgttgcctaatctaaatttaggtcaaaacaaattgaccttataggtaagcattatatctattaatattgtatttttgtattattttataatattcatcattcacctattttctcatgcaatatatgttactgaacacatatagattaaaaagccttcatccctaaataacaatgatgggaccttccatttttatatccctctggcatttaaaatgtgcttttatagccatcatctccattgatctctcagtcccttgaggttgatatgacagatatgctttttccattttaaaattacggaactgacagtctcagatgactttaccctccaactactgtgtgaagaagcagggtctggcactgaggtcttctgacatccagtgtagagcactatacttcacaatatggccattggcttactttattacaagcactaaatattttccactgaatacgtaatacctagaggagaatgtcgtgtaaaacagcagcagtagaacagaggattaaatgacccattttcttgaagttatcttagttttaaagggttttttcttcatcactaatgaccatccctgactaagaaattattctcataatacatgataatatctgcgttttccaatgcgacaagaatgttaggatgtctatacatgatcttgacaatccctagctccatcacaatgtgtccaaattcattttatttggctagacaggcatgtagtcttactttcaatggttggctctgctggatgctatgtgatctagaacctgtcacttaccccttctaaacttcaggaattttttatccttaagataacaagaaaactcgtacctgtttcaaagagctgtttgttcaatcacctatccattgattatcttctatatgccaaatgtttttctaggtgctgaattacaggaatgaatcagaagcaaaaagttcttactctcaaggatcttatatgctaatgaaatagatgttaaaaaataacaatttttgtttcattttattttattttattttgttgagacagagtctcactctgtcacccaggctggagtgcagtggcacagtctctgctcactgcaacctctgcctcccgggttcaaatgattctcctgcctcagcctaccgagtagctgggattacaggcatgcgccaccatgcctggctaatttttgtatttttagtagagatggggtttcaccatattggccaggctgttctcgagctcctgacctcaggtgatctgccctccacggcctcccaaagtgctgggattacgggcatgagccagcgcacctggcattaaaaagtaataacaatttttaaatatcaatatgtcttatacagaaaagtgagcagtgtggtagagtgtaactggaatgtgagttgagacataacaccagacagagaagccagagaaggacttttgtttgaggaaatgacatttgaaaaggaacctgaatagtgacagaggcagatacctaaagaatatgttccagacaaaggaaacaaaaagcgtgcaattgcatagtcaacttagcctacttgaggaaaagtgtgagtggattttggtgatggagaggtaagtgccaggagatgaagggagagatctggcatgcatcagatgatgtgcagtcttccgggacgttgtaaagagttgggctttttttgtttataaattaaatgttaagccattggggtttttaaccagaggagttatgtgatatgatctatagttaaattatgtttgttcttggatggagtgtgcattatgggaatttatacagaaacaagatttcacatatatatatatataaaactcagtgtcaatagaaaataataaaaacaaattttatccattgataattctggcattgatagtagtgggtatggtggtaataattgtgtgtaacactcaaactttctgaaaacctacacttgatctgtaaatccaaaagtatatgtagcaaaagccataatctgctcttatttctgcaccacttgcaccagtgtggagtgataaggcaaattattcaggcacctgtgtaagccttcagtgtcctcacccccttgttataactctccactaatattacattggtaaagacgtccctgacctatatgtcactgagacctcaaagaaaagagcaaagctaaagcgtaagggggaaaaaagccagcttaaaaagacttaaaggtttctgggaccaaaaaaaaaaaaaaaaagtctttgaaaaatgagaaaggaaggatagaagaaaagattctcctttggtcaatctggccaacctttggaaataaaaagtattgtgttgcagctaataactatttgtcactgcaggcacttgctgatgtctgccctttaaaatgacccaaactcgttggcctcgaaatcagaagccaaggaaaaaatcttggacataatgttttctgtagaattaccaattttctctctctctctctctctctctctctccctccctctctctctctctctccatatctatatatatatagatgtatatatattttttctgtaggaactaccaattcctatctatagggactgattgagaagtcccttatagcagtttttctttggcttttaggatgcaatgattattggtgagaataactctttcatttcacatttgtcattggcttatttgaatgtaatcctgattcaatcgttatgatctcctttaagtaggaagagaagctggtattacattgtaggattttaattttgtactcatgaaacttttgaaaaacattactcatactcttctgactgtcaaattggcctctaagaggtccacatctcaagaggtatcaagcattggtaactattttttggtgttgttttctcatcataaaatgtacttttattaggtgactttggaaattttattgaatcaatgcatgacactgcctcattctagtaatctgatgaagcaaagctgaaaaacaaaatttgaggattgtcagtatatatacttttatttgcagtcaagagttatgctgcaaaaatggtttattgaagtaacaaaattttagctgatatattaatctgaaagatacagtatacatttttagtatggaaaagatgaggaaaaggaggttctctttcctctaggtatctagagcaaactgtaactgtccttggtatttaatttttggctaaggtactgagattagaggtggggccttagatatgattaattgtcagactgataagctagatatttcattgagtttctgttgtgctctttctttcagatcctctgttcgatgctttgttataaagatttgggcatttcaaaatcttctccatatctggtgtctttccaaacagcaggtcatagactttacacaaagaggaacgacacaggttataagtagaagtgttttaaaccctgagttcctatttcagttttgctttcttaaacatattttccttatgtgataaatgcgagtgttgaatggtgataaataccacccataggctttaaagcctaaatgttgaatttgacactgagagtttaaaggcatcatgaaaatttctccagaactaatgttcaagcaatttaggttttacaggcaactcaatagttttgaatgatgtagttattttgaaaaagtcaccataaaacgctatgtttagggaattggtactttgcatttatcagaagattgtaaatgtcaatcgattggcttgctatttggaatataattttttaaattatagttcaaatcattaggatttaattcatgattttgtactacaaactaaatctatgaaaaatatcagatatttattttaaattagaggcatgtaaaggaaaatataaattttgaaatgccattttactggatttttctcttcagcccaccctaggcatttgttacataaaatatttctgaggaagtcttccactgattttgtaaacaaacatgttttattgaacagttctttgttgactagattaacattgaccattgtatgcaatgcattctcaaaatcttagaagctggttttctttttaatcatataattttacttgttttacagtgaaattaatgcatgtaaaaagtatacctatatagaaagttaaaagaatattgctaactagttactatacttccaaattgcctattttctgtgtcttgcattggacagtagtgattacctctaaaagaaaatggatggtctttgtttcattgaagggatggataatggacataactggcattcttgagcaatgcaattgcaaatacatgtctttgcatttatggtccaatcatcttcttactatgatagcatataattgaaggttcaaataaatgcctcgtcccttcctgtggcatattaaagagaaagaaaaattagaaatactttcaaagctacctcacatactaatggtagagttgtttgagtatttaggtgatttaacaaagctgatgtattttattatgcttgatcattgaggaaaatttatttatcggaatgcttttgagagcatatatattgtcagagataaacacagctggatattaaagaggtaaaaacagattttattcaatacctcgtgaaattaggggagagctgagatccattctaatttgtgcagaggcgacttggttgttttaaggcaagaaggagggagaaggagtgggggttcattcgagttagagaagtaaaaaagtacaaagggctggacagtgtaaatgtgattaggccagctgtgttagctggaagttattgaagttaggattctatcttcccacagagaacaggagacagaggacttatccttcttgatgatgtcatttgaaaagaatggctttcaggtccttgagtgagagacacttctgatttccaagagctacatgttcacaattgtaagcccttttgagtaaatgttctaagaaacggaggtaagagtcctatcaacagatgtgtgttggctagaacaaacattaaattttcctggcagcactgagctttctcaagcaggcacttaagggaaggctagggtcatcctagggacatggccttctggggctagaaaccatactagagtttagtcaagtcttagtgcaagggtttggacagagttgttaagtgctgagagttctgtatttctcactgtcacaaaggaagatcagaagctcctgatacttttttcatcagtacaattgaatatataaatcctatacacaaaaataaactaagcttatacaagcatattggtcaaggaatgttgctggccttattaattagatagcccagttaaaagaagaattttttaatataattaatgttaaagtaggatgatagtatataaaacgtgtctactgtcctgaatacaaactaaactgtttggtttagcatttacctcaagatctcttaatatcccccaaagggtccctaaaaccacaacttatctttgtgctcatgaagtagagaagagacagttaatagacatttctagctgatagactgttgtagagcagagaacgctctgtgtttttgaaaattaaacatatgaatttgcccctcttcccctattaaggaagaagagtttcttaattgtgcgaacacatcaagtgaactattcaattagatttttgtgacccagggtataaacatctggttaaggttacatatttcaaaggaacaaaacactagaaactcttggttttaaatctcatggctggaggataatttgcagcagagatttatctggcaagcatacagaattgctgagactgttctaaagatgtaagtgtgggtgtttgtgtcgtgaaaatagctgtttacatctattaagtggataccgatggttgaaagtgccgtctatgtcaagtttttaccaaatcaacttttgcctcactgtgtcagaccattttacctaatcaacttggactgctaatgtcctttcccctggcaccactatctgtctcttttgcaaagcacagaaacggcatgcatgattgtagtttataaaacacatgtaccaatgtggtctacagcttctgttgagttcgagagggtcagtttctgtaatctcttctggcacagagtcaagaacagcttcactttcctcctgctacctctctacccgtaagtgtgaacccatcactttgctaacactcaggaaggggattacacaaaatagagcaggagccctctgacctgaatatgcatctgagccctagccatagagcttctgattcagtagatctgggatggggcctaaatatttgcatttttaagtgtataagtgatgctgatgctgctggttccaggaccacattttaagaaatatcgataaaggtggagaattaaactgcagctcagaagacctgagttcttgccccagcttgacttttacaatctagcaaatggataaaactcgcaggacttcagttctcttcatctacacagtgagtggttagattggctttgtaatttaaaattaaacagggtttgattctgattcactacacaaggttccaaagaaggaatgatatctcctttcatttcttcactttgtcttctgtccctaggtaatcttatctatgttcctgatttaacctaactaatgtttctgcaaagcttctaatatttacatctccagccctgaaactctcatttgaatgctagtcttatatacatacccccctgcctaattgacatctccacttaaatgtatcagaggcaactcagactcaacaaggaccaaactgaatgttcgaccttgtccttcaaacccgatacacatccaggttcctccatcccagtgaatgacactatccagttaagcaagccaaaagtctggattttttttcctcactcttcctcactgtccgtcaactaccattattaaatctgtcacctggtcctactgatttaaccttctcaatatctctacagtttttctttatgcccattagtatcctagtgcaagctaccatcgtctctcattggaattaacacagtaacccccctacccaccagactgttctgcctacagatagtgtgatatttaataaatataaatctagccttggctagatttctccttcaaaaggttcacattaattttagccttaaaatggtgtgcaaagctttgcatagtctgtcctttgctatgttggcagtattttttactatccctctcatctgctcattctctgtactccaactacactaactttgtttttttttttttttagatttctctaactacagtgctgtaatctctttttcctttgcacgtactattccgtttgtcagggaatctgctcactgtctccacccactccacacactcacgttttcctgcccgtcttaccggtcttgatcggttgtcacttgctcaggaaggtttccctggtcaccccctccacaaattgaattaagtcctcttgctgcatgctgtcctagtgctctttattttcctctcctcatccttaattcagtttgtaattacatgttatttgtgtgaggatttgattattatctgtgtcacccactagatattgggcattctttacttactcaccactgaattcatagaaccacagtaattgtacacaacaaatattcaagagaaatttattgaattgatgaatgaaaagttgtaccttaacatgttcctgacatgtatccaaaaaagagctcccctttggggtctattaggactttggacctaggtaaacgtaaccctagtttcgctcaggtttaaacagtagaaagtaattgggtctcttttgcatgtggctttcctaagggctaaccctgtcttcggaatgagtcaatacagcagagctgttgaaagcagactctagcttcggacaacgttggtccgaatcatggttccgtcatttcttagctgtgtgatttagaataaattaatgttttaaagctttgatttcctcttccttaatctggagatgctaataaagccaacttcgtagaggtattgcgatgagtaaataagcataatttgctgtaaacaccttgcagattgcctgttgtatgctaactaatcaataaattgaagctcttaacatcattatattagatatttccagcattgagtatactatcaggcatgtggtagaagctcaatataaagttttgttaaattgaatagattccatatatggtatttctacagcattatgctccttatttaagtgtctctaagtattttttaagtatcacctcacaaaagacagatgtttaattcattacacatgtgaattgttttagatagaaaataaaataaaaaattcaaacattgaaatcaatagtgtaccttaccttaggattacaccataaaatttctaccaatcgagaataaagtgtacagtctatttcctttctaatacttttaacgcaacaaatgtttattgaacacttactacttctaatctatgacagacataaagatgaataaagcatgccacaatgtttaaaggagctcactatatcataagaaagcggattcacacagacaactctataagataaagtggtaaatttaggctggcctgtgaaacaaaggattataggtatagttaagaggtggaatttattttacttcgaggatttcagttacctttatattctttgtctaacctttcatgtttctctttcttcagaaacagagcacctttttcctgacacattcatttccccctatggagtagagcagttgttttcaaagtgtgggtcccagatcagcatcacggggatggttagaaatgcccattcttgagcctcacaacagacctactgaaacagaaattcttggagagtggagcccgcagatctgtgatcaagccctgtaggcaattctaacgcacactcaagttaaagaaccacgggaagaaaggtccatcctgtaacaagacagatttttttcattagcatcaattttgatcatttatatatatatatatatatatatatatatatatatatatatgcatgctcacaaaaccattcaccttactaggttttagtattccccttcctgtattcatgtggtatgtatgtatacaagatgaacacacatttacctgagacaaggtaagactacacatgtctcatttggggaccagaggctgtaatcttactcaaggtcaaagcgtcttcactgctttctttcactgcttttcaaaagtaaaatttccatgtaggtgtcatttgttttctttttgtgttttagaaaaccgattaaggggtgaagtctggctaaacttagtgtcaggacatttacttagataaaattattttaatttatcttgtaatgttcaatgtgagaagaaaagtccttatgagtagtgtattccttaaataacaacaatttaaaaactaccactgaagtctgtcagagtagttttgcctcatttgtctagataagagaaaaaaggttcacattagggattgcaatttgtctgccaaagtgcagtttatttattcagaaacatttagagaggaatgtgtcagttctgttgcaggcactgtgctgtgacggggagctcaagatgatctcaaaaaatttcacagatggggtgggcagggggcacagagagatgtatttagtggttcagatactatttagactgtggccagcatttctctaaatgcaatccagataacaccttacagaatcatctgggcagcttgataaaagctgtagactcctacccttcatcccaaacctattgaatcagtgtctgtgtgtgaagacctagattgtgactggtaattataccaaagtcttagaagcaactctaggccagtaatactcacatcagaatcagctggagggtttgctataccacagattgctaggttagccttcagagttgctggtccagtaactttggtgcaggtccagattttgcatttccagcaagttaccaggtgatactgatgctgctggccttgatcgtgctttgaaaaccactgctttagctacgctataggaaaaaccatataaggcttttatactggccaatgacttcacaggcctgaattttagaaagcccccttctgcagcttggcctatagattcgaaggaaacagaactaacacaagaaagctagttaggagctagttaaaaatcatcctgacttgccaaggaaaggtgctgaagacctgggtcacagagcaaatgcaaaacactaggactttgtccctagttcaccattaaatcaacttattttctcttaccccctcatattcacgtttactccttactttgtagtggttggacaaaaatcaaataaatctgagaattctaaaatgcacacccttgtttattttctaactcaaatatgccactgttgtctgtgctctgtcaagatttcaacacatctttttctcctgtttgcttttccttttggcatatagtgagtgtgtgtatacacacacacacacacacattttttttgactccttccaatgcccttctgctctccgcagatacacttctgcattctgaataaaaccgaatacatatatatatatatatatatatatatatatatatatatatatatgcacacatattttgaaaaccttatttgaaaagaaagctttcggaggaaacgttatttagccacttaatcgagtcttttactgagggactttttgtcgtcccctaacttcctgtcagcagtccacaggcagcaggaataatgtgggagaagatcaacaggcttatttcaggaggtcaggggccagtgccaccacctgcaggtggagacatcagaagcaggaagcagcccaccagctgcagggagaactccccacagagcctaaccaagatgaagggacttgtaaatttcaaccctcccttttggcttttgtgctaaaaatgtgaatattgaggtctgccctgattaagaactagatacattcctctttgtgactgccacacttccttagcgtattcattttttgtctttcgatctcaagttattattttcaaatgcattgcacgtatctaccatggataccattgcaattggaaggagcaaacgttttgtatgtttacttgacaaagagaagtgactgcccaagccacacagagttctgcacaaatcagtaacttctaacgaacgtttgcacttccgggcttgttctctacctatttcagtcgatgcatttgtattatttacttcaaactccaatactaataatgcctcaatcaggttgcaattgggatttgagcagccagaatttcagaaatttggtttggtccatatctgtgacaggtcagtaaatcagagaagcaagggtttggttgctattataatacattgcttacctatcaatttagttatcagccaaggtggttgttatcatccaaagtggctcattaaccaccttggagactcagtatacaattgcaagtaaccctggaagttgtaaataatcccaactgaatttgtatgagtttggtaaggttaagtggaaaccagctgcttagggccttgattataaatgaagttaggagtggaagaagtaacaaaaccccaggcaaattcattaaacattttttcccttcaactttatgctcacgaatgtgttgagactcttctgaatccataaaacacctttcagcatcatctgggcagcttgataaaggctgtagactgcctgcccttcatcccaaacctactgaatcagtgtctgtgtgtgaagacctagattctgactggtagttataccaaagtcttagaagcaactctaggccagtagtactcacgtcagaatcagctggagggtttgctataccacagattgctaggctagccttcaaagttgctggtccagtaactttggtgcaggtccagaatttgcatttctagcaagttaccaggtgatgctgatgctgctggccttgatcatgctgtgaaaaccactgctttagctaggctataagaaaccatataacatggacaaggcaaatgaaaaggttggaattcttctgaatcccaacacatttgtgagcataaagtcgaagggaaaatgattcttctgaatccagacacatttgtttaaggataaactgttttttccttctgaaaatttaatgtctgattctcgttcattcattcatcaaaagttatcaactatcaactataggtaggaactgtgcaatatgctggtgataaagagatgaaagacacagcccctcccttcaaccagctcctagttgaggtggcaagtcagctgtataatcaagtaattgcaagactgtgcactgaaaagggtgaccacagggtgtgatggccacccagggctgtggaatcagtcccaaaatgaagaatgaaagcagggaagggtaattcagaaagaagaaacagttcgcataaagacccatagataaacatcaatcagatgtggttaagacaaaagtaagtttctggaggctgaggaccttctcagctatatgtttgcagtgcttggtatagggctttatgcatctacatggaagacagaaagggccacatcacagtggacaaggcaaatgagaaggaggcagtatcagaagatgagggtacaccggagatcctagttatatatgggcattgtgttcatctcaggagttactgagtaatgggaccttgactcaaatgaatctcaagtctgtttttgcctaatcttggttttaggactaggattagcatacaaccgcactaggagcctagttatacgaaaggctgcattgcggacctgatacagttcaatatacatactgtcaccttgcaaatagggttacgttagttctcaagactgccaatcctctgtgctctaatccttttggcttttttttttttttttttaactgtctcactctgtcatccaggtgaagtgccctgggatgatctaagctcactgaaacctccgcgtcccaggttcaggtgattctcatgccacagcctcccaagtagctgggattacaggtgctctggcgccaccaggccctgctaagttttgcatttttagtagagacagggtttcaccatgttgcccagactgatctcaaacgcctgacctcaagtgatctgcccgctttcctttggcttttaacactatagagcaagggtccccagccctggggccacagaccagtacaggtcagtgacctgttaggaaccggggccccacatcaggaggtgagctgcagggccgccagcattaccacttgagctccaccttctatcagctcagcagcggtattagattctcataggatcacgaaccctattgtgaactgtccacacgagggatctaggttgtgtgctccttatgagaatctaatgcctgaagatctgaggtgcaacagttttatccccaaaccatcgcctcccacgcacctctccccacaaccccacccgcccctgatccatggaaaaattgtcttcctctaaaccagtctctggtgccgaaaaggttggggattgctgctatagggcgatggttttcacatttgatcctgcatcaaaatttccaggtgactcattaaaatactgattgctgtgccccactcgtaggagttctgataaggtagctgtggggtgagacctgagaatttacttttctaataagttcccaggtcatgctgatattgctttgataaccaaagcaatatcagctttggttatcaatatataaccaaagccacatagagggggagaagttccttgggtttagcccagtgtttactgcgaccaccaaaattgctggagcttaaccatggctcagagagttatgttctgttcactctgtaggctgctattccctgtcaccttttgaactatgatggaggggaagagctgccagctcaggagatttcacttttttctctgcataattgaaaatccagaaacacagggttttgggaaagctatagaacagatcatcagtgatcagtgtttaataaagtaaagcaataaactttactgtgtaaaataggatactttattatataaattttgtccccttcccccacctcacaggccaataaaataatatacttcttgtccctgggtgtaatgttattggaaacctttgaatgtaggagaggcatgggcttgtaagttgcagaaaactgctagcctaggattgagaatttcatggataatccaaaaatagatgattttacagttataagccttacgtgaacttgaggtaagaaaacacaatgcctttatagtcttctcagttgctccacatgccctctgagattctgttctgcccagcctctctggttgtcacatctctgggcattaacagaaagttcacatactctttgtctctgatgataatccttctaggtccatatagaagatccctatccaaaccatcccccaaacaaacctattggttaaatattttctccaccgaaggcactttcttagattctaagtgccctgtaggcaggcttcctctctgatttgggagagtacaaattgcgacaaggttaaatcatagcctgggaatttgacctaaaattcactcttctcccatatgcattcatgaaccttctgctggtttttaaaagaagctacttaatgtcagctcgaagaggttggaaggggttaaaaacatgagcatggcagtaagaagatttatgaaggatctgagaagattatgacttgatcagatggtattttgtcagctagccacatttgtgaagacttgaaaactagggaggcttgtccttctaagagggggcactgctgggacctggattctgtggaaccgtattagtagaataaacaataacctttgcttgtatcaaatgaacttctattctcatgtgtcttttgacatatttttattaatcatatcactgggacctccttgctgaaagatatctccgttccccattctgatgactcccaactaggagtgagatcaaatgaagatggcatggaccatttctccatgtgacagctctctgtggttgccttttaacacttctaatgccctttctcttaagaattcccatttgtcgtctggcactggtgctgtgatcaataaaaatgtaatggagtgaggcttagaaacatgaggaaatttactcaagctatccatttattgatgtgtccatttgtgttgtcagggaagaaaaactttttcactcccctcttaggttcattacttggggggctgcaaattaaactgacgacagatagattggcaatagaaaagacaaagtttattcagagaagtatgtgggagctcacagaaaacatagctcaatgaagttagaatttggggcttatgtactattttaacaagggttttgaaaagaagagtgttagaatttcaagccacaaagttggtgggaaatatgaaagaaactaatgaaaggtaatgtttgttttagtaaagtctgtttatgtaattttcttttcccagcgacaacttctcatctctggtgacaggagtcactctttacccctggtgcaagaaactttccttaaaggaggatttaaaacagttgaattatttcagaaatctttgcttttaggcagatagggggagtacagaaaaagccccttcccgtatctgttgatcctcaaatggctttagctcaaaacaatttttacatcacgatggcataatgtagatctcttcaatgtgttcatttattccacagatatttgtgaagtacatgatatatgccaggtacttgggatacaagaatacataagtatgtccctagtctcgtagaacttacactctagtagtgagctagagaataaatgatattatttattatatgcatacacatatgatttcagatagtgatccatattggaaataaagctggttaagggaatagaaaatgatattgaaggtggacttgtttagattgggtggattggcatggcttctctagggggcagtatttgagcagatatgagagcagatattctccaatttgggcaaaaacattccaggcagaggaaacaagggcaagggcactgagttcaaaagagacttgacctagccaacaaatagcaaggattccagtgtaagagaaggtggggaaggaaggaggtgcaagtataggcaagggcaagatcacacgggatcttgcaggccgtgataaaagaatttaactctttcataattttgacaggacatcattgaagaatttagaaaaatagagtggagatacctgatctgctttcttcaaagagttcattcatcattgctgagtagaggttagactgaaatggaagcaatagtgaatacagggagatagcacaggaagccacgttactagtccacatcagaggtggttcagactagggtggagtggtggggtcagttagagagctggtatttaggatacattttaaagacaaagctgacaggatttgctgtgatgaattagatgtaaagtatgagaataattgagaattatttctaagttctttgctggggaaaagtggaggaggaaaaagttagggtacaaggtgtgatgaaatcaagagtctctcttattatcagagtctcattagatatccaagtggaaatgctggaaagaaagttgggtagatcagtctgaagctgaagacagatactgtgactggaataataacgtaagagttggccggacacagtggctcactcctataatcccagcactttgggaggccaggataggagaattacttgagcccaggagtccaagaccagcctgggtaacacagcgagacctcgcctctacacacacacacgcgcgcaaaaattaatcgggtgtggtggcacatgcctgtagtcccagatactcaggaggccgaggctgaaggatcacttgagcctgggaagtcaaggctgcagtgagccgtgatcacaccgctgcactccagcctgggcaacagagtgagaccctgtctcaaaataaataaataaataatgtggcagtcataggcccttagatggtttttaaagacatgggactggatgaagtcttctaggaggagagtttgggaaaagagcccgagaattgactgcacctttcaaaacaggaggaagaaaaaaaatactcaaaggagacaaaagcaacttctgtgatttatagagaaaaccaggcaagtgggatgaagaaagtccttcatgatagaatcaaaaacagtgtcaaatgttgaaaatacaattagacaaacacaaaagaatagaccattgggttttgcaatatggagctcatacttgaccttgataaaagacattttcactggaagcatgcatcaaaaaactatttgtggtaggttaaaatgtagtaggaggtgaggatatacagacagtggctttcactgtgcagatactgctgctcatgcactaattaaaagacatttgttgagtatctactatgttgtatccattgctaaatagtaacagctgggtttagtcaggtagaacagcatcaaaatcattatagtatcccaagataggtacagtaaaatctgtgaaggaatcagagtagtctcttctccaacagagcgtaagacccagcttcacggagaaggtggtagattagctcatctgggaggctgagtagaagcttgtcattatagagggagaacatcagaagtgtggacaacagcttgaataaccttgaaaggacaaaagaggacggtctgccctggaaatattaagaagtctcacatgattagacacaagatattaggggaaaggcataaggtgaattgagtcaatgaggtcaaagagaagctagctggaggaacaggcgatcataaaatgagtaaaagtatatattcaaagattctttttagaagggctacacaggatggataaggggagagagagagttgaggcacagagacaaattggaaaggtgcaatcataaccagagacatgaaaaacccatagaaatctgatgtagattatgtggtccccaaggttgaacaattaagtacgctttcagttgttatgcccatgatattaacatattttataactgcaataagtgctgaagctaaagataaatacaaacaatgtaattcttattctgtgagaaaatgttgtagctggaagttaaacatgtttcttagctaaagaaaaatattgtgtgatctggattacttaatgttataatttagcaacaaaatgttgacattgagccttgcataatcaaaaaagtagtctattcaataaccacattctcagaaaaaaaacaagaaaatattagaaacaatgataaattatcgtagtaatttaattcagtattctattgttttatttggatttaggaaaggcagaaatgttgaaatattaatatatatccctgtaataatataatttgtgtctgagaggtaggaatgagggcatgaggtcaaagtttgataatgaacttcaaagctataactatgatcaggaaattaaaattggacaataaattcctagaatcgtcaggagttgcttgtgaaatcgagaaaggaaaggatatacacaaaaataaagaacagccaatgctctcaaaggagtctaacttttataatagtcttctgtgttagagctgaactcttctggtttagaaggacactctgttgcctggaaatagggcatggaaaaagtcatcagagtcatgtcatctttcattcttcccatgaacgaaatcgaggccctgaaaagtcacctgtgtttgctgtattttattgcaactaagatgtgcatttttaaattgatacataataattgtacatatttgtgggatacatgtgatattttgatgcatgcataccatgtgtaattatcaaataaggatatttctgtatccgtcacctcaaacatttaccattgctttgtgttgggaacatttcacgtattttattatagctattttgaaatacaaaatagattgtcattaactatagtcaccctactggatgcaccttgtttttaatatttctgaaaacagatacgtctcataggtgatggtgtcacagctgtgcattagttattattgcctgtgcaggtgcaaacgtaactattcatattgttgtcaattaattaaatagttacatttatttatatgcgtttattatactaataaacacaatattgagatagttgagctctagttttgactctgctgttaactagctgcgttactttaatttacttaactaatttggctttcaaattcctgataagtaaaattacaacatgagtttctcctgctataatagcctgagaaatcggtgaaacacatgaattcagatgttgatgctatttaatagcgggattccagatatctacttgccattatgggagggagagaggaggtggactggaggctgtgatttccctaggaggttgttaaaattggccaggtgaggaaagctgagacagaccataaatatgaagcatgatacctagccctcagtgttgaaagaaaatcaaatctcatctttgtggtctaaatatcagtatgatacaatcctctgtgtagacatatcctctgccctattgttttctttctaaaagctaaagcccaggtgtgatcacatccctccgttatttacaaatttctgatgatgatgattcttctaatatctacattccttaccattaccatgatgtccaaaacctattataatctattcgtctccaagtgccatgttgtggtcaccctatgcaccctctaaacccaccatatgaccttcccgctgctacttgaatacagttggccctctacctcgttgtgtctttgcattgcctatttaattgcctttccattctctaaatcactctttcgctggaccagcaacatcagcaccatctgggaattcattagaaatatagatcctcaggcctcatctcagacctgcttgatcagaaacattggagagtggagatgagcagcctgtatttttatcagccctctaggtaatttgatgcacactaaagtttgagaaccactggtctagagcattcttctttaactctcttctaaaaattattagaatgaattcgagggacgggatctccttgaaagccaagaacatttctttgtcatctttctgacttcagggcgtagtacactttttggcccataattaaagctcgataaatgcattctatgccaataaatcagctaatcaaatatattattcatgcccttgaggtatctgaaatttgtttgcagaatgtaatatataactatagagtaacaagagaataatttattgccatagataataaaacaatatcctctgtataataaatcctagcctctgctcaatgggcaaaaacgggactggggtttcagattttaaaaagattattggtaattaaatcacctggagaagcacttgctgcagagatgggacttgaagcatcataataaactgttgtttattatgattcggtcagagctgatggaatcacagggattgtgtgaggtatggaaagtggttgacattgaattccaggctgcacagttgggacttgatatgataaccaaaaagaaagaatgtctggggtggtagcaagctctaaatttagacaatctaggcttatcctaaggagaatatagatacagataactgaagtttgattaaagggaacctggtgtatcacaaatagtaaaaagctgtagttagtctatgcagctatcagctagccacataatacttttgggcaaatacattataaaccaaaagaatgacatggcttatctctgtaacaaagtggctcattgttctttattctactgttatccttaagaaaaaaattttagtaaatttgttatgctatactcaacttcaagaagggatagcgcttataaaaaaattgtttaaagaaacaggcctatttctctttgggagaagccacggagaaacgaaaagaatggaacgtgtgtttctgcccagatggcaataaaatgtagggtaaatttctgtcttttaaaactgtattttttccatccctctgtatatacacatatcctaggactgttataaaatgctgcatgcgtatgtgaaaatggaaccttattgggctgtttgatggacctttaaaatatatttgttggtttggggtacatactagctatgcaatataatccgcattatttcttatgtaaacaatggataaactgtttcacagtccagacatttatttggtcactgtttgtagaatgtctattttatttacttctgaatttgtattccagagatctgccttcaatgttggatacttccactgtaatattctaggagatgctcactttctttttcagcatctgacacagtaccatctgcctcctcttttcttgccacaagtaataacaattttataaaggaggatcacattacagaattataggtggtaaactttctaccaccagatttacccaagaacctgaaacacattttttcaaaaggaaatagaatgtccttcttgtgactacatcggaattttgcttgcagcattatgctttttttttccccctagtgtagctagccatgtggaactgaagccattagccagctcctcatcctataaatgctattacctgggaaaagaggcagaaaatatactctcttctccagttagagtctaaaggaagagaacaatatgggtagttgtgtttaccacaaattgatagaactcctttattttaaatgctaaaaccaaataacttgtttatatgacttcaacattgactatcacacactgttgcatgataacagagtgaaaactacctctattggatttaagtggggaatctatgtctcattctcattctttttttactgtggaaactagttgattccaggatcagccttagctccaacttgccacactttgagttttggtttttcacttgcattgtcacaggaaacttctataggataaatcgaggaagattttactctgcaacgtgttgcagaattaaacatttaaagtggcaaaaccttcgtgtgtaggttgtctccccagagaatgtaaaaatgaattgaaggcagcacctaataggtaaacgacagccaatcaaacaagaacaaatgaaatttgactggcaaaatcaaattgaaaatgtataacgctgaatctcagaatataggaggatgcatagaaactaagctgtactattataaaagtcatagccattgaaaaataatgactggttaatttggttttctttacctcatggatgtgaatggttagattttgatgttggtgttatttgacgtgtgtttgtcaagaagttgccttagtcggctcgcatttaggataaaaaaaatattttaagaaatgtttaagagattatgttggagacattagaaacaaaataattatgcagagggcaggactatcaaaatataatagaaaaattacaccgctcttttatgatttcctcctttttggcatttaacacaaaactttatgattacacacaccacgcactccagaaatgcttaaaggaagatgagaggaaaattcaatagaagtagcaggcatttctgtgaggacagcagaatgatcacttcatctctgtattttttttttttcaaatttctgtatctgtacaatgtcttttccagctctaatattctgtgatttggtaatttccgcactcagattttctttaatgaattttgtatgatattacctatttttataccagatattacctggctctaatttctttttcaccctaggaaataaaagtatcgggtgaatttcccattttcttatgttattgatacaggtctctgttggatatccccacgattaactttcctgcagcatgttcgatggtggcttaaagaagaaaccatgtatcagagccccttgtctatatagacttttagataaagagaaatacatatcacagaattattctgggcgcatagagtctctaaatgcaaaaaaaaaattgtattgtagctgttgattcttctcagatagattgagtgtagagagagagcattccaaaaactgagcagaagaaacacagtctgaatcaaataacatgaaattttagctaacaagtaaataacacttttttcagaatatgcaaataatattggtttattatgaaaaatgtataggctgatagatgagcatagagaaaaaattataaatatcttctttaatatcactttccccagcaaaccacttttaacattttgatacattttcatgttcaaacatttcctaatagtcttttttcctgttatataaatatgaattttaaacattcgtatgtttatgaaaaggcaataagatactgctcttttataacaggctttctgaacttcacaacatgcagtgtattctaacatgctccttgtgttcttaactaataaaaaacctcacgttatttaaaaaaccatcttaaacataattatccattaagagaagaggttggggtagagagtttcagactatcaatatcaaagttatattttctgtaagtattttaatttttaagtgtagctataggtatatgattataaaaccaatagcagagaaaagataccacctttgaatatagttttccttggttccatgaaaatggcctcctttctttttgccagtccctcagtatcattaactcatttttctgtaaatgccatcattgtatcacatgtcctcaggaaaaggcacttttctcttttaagctagtgtttgttcttgttctaattttatggcaatttaacgagtaacaatcctgtttctataaatactgtttcctaattaatctattgcattctatccatgagaatttagatgactttctttgtaagagaaatctctgtagcatgagattcttctttgctcttaaatttcattctttcacatttttaaatgacctgatagtattttgttgtatttgtgctgattttttttaaccaatcttaccttgttgaacatgtaagttgtttctaatatttgcaatgatcaaaatgtggatccaacttcactaaagcgttaagaatctaaaacaaaacaaagaacaaaaagttggctgtcatcttgcttggaccaccccgtgagttactattttcttgtttccggtcacagttcatcctaaatcatttcagtacacaaaatgttttttaaagtttgggacagggggtagagaatgtcaattattcctccaaggcagtcatatgagcattgagtatcatgtggaatagttgttacttgtaaagttatggggcatcaaacccagtcaatatgtttctggaattgaaaaagtccctggacattctaatgatactgttgttcactttgcacctactgttaccactactttgatctgtcaacactgcccgtaatggttaattttgtgcatcaacttgactgggctacaaggtgcccagatatttggtcaaacattattctgggtgattctgtgcaagtgttatcagatgagattaacatttaaattggtagactgagtaaagtagattgcccttcctaatgtgagcagacttcatgtaattaattaaaggcctgaatagaagaaaaacactgaccctcccctgagcaaaagggaatcgttctgcccgactgccttcaaactgggacatgggctttttcctgccttcagactttaaccacaatattagctgttcttgtatctcaagtctgctctacttcgattggaactacactatcagctctctcgggtctccagcttgcttgttcaccctgtataccttgggagttgtcagtctccatagttgcctccataattgcatgagccaatttcttaccacatacaaacacacacagagacacacacacacacacacacacacacacacacacatataattatatatgtgtgtgtatacatattctcttattccttttgtttctctaaggaaccctaatatactccttattactctttctactgccttagagatcttcaaggccaagagcgtaatcctccatcctggctctttttcctaatcattaatgatcaactcatagccatttagctcaactaaaaataatttgttcatgaagctttacactcccacatactgaggaacgtggtacctaagatcaaacagtcactgcctcatcaaatgcattcctcttcaaccccatacaaatgtccccagatggaactcacaccataaaaatattagatcccattgacttttctgctttctcaaggatcattgcagagcttgaaaaagatggctcctccctttgcctaagcaggttaacttggtgtaaaagtacatgtaagatttggcacaaaggaaaataaatcagttttgcctgggtcctaagaaacatttccctctgcctcatggtaattgtacctgccagttgattgcattactcaagtggagaccatgaagtgaagtggtagaacaagaagaaatccctataattttattaagtatggtgaaaaatacagatatgtagagaaatgactgggattagatggagcaaaacataattcgagatcctgatacaaattgtacttcctggctcaagggagggagcagaacattccctgctacatgggaataataataaatgcctgataaaaatgcagatatatcatagactacagaagctgaagtggattcttatggtcccctactcagacagcctctccttcagatgaagaaactgaagcacagaaagctcatcctagtgtttcatattgaaaaacccattcaagtctattttaataacctgttaccaaaaatgagggaaataatttaactttaatgtttcactttgcattacccttttcctgactagacttctatccttttcttgagttgagctcattaactactatgaaattatggttatgggtagaggttaattttatacctgtccatcttctggcatcttatttacactaaaaatcatttttaaatggcttcattttaaaaaatattatttcagttgacattttaaaagacacatcatttatgtactacagaatatgcattttatactctcctttattaattttattattttccaggtagaccaatcaaatgaatcagaaattcttggttagatctattagacagcataagtatgtttttcatcattaaattaagatgaaaacacaattttactttaaagtgtttgacgtttccagcctttataaagtcaacacttaatcacatctgaaatttgcaggaaaaaattttgaaagccttcaattattaacattatttcgggagaaaaagccactttgccgcagaactttcacttttctctcgtgaattaagtctgatacaaattattcattatggtgaagtttaaacataatagagtctagctacttccacaaaaatactattcaatgagtttctacattgacatctaactgaccttgtaattaatgttgtacacgatccttttattatatgctggattatcaaatatgacttattagcagtataaagacacaaagttctgaaatgtaatttatagccatgaaaaggaactgagctttgtgtgacagttaaatttgaagagatcaggtgattattatgaagcatgaataataatgcatattaaactcacgtttttgtttaaatcattaatatgattgttttagaagaaagtctacctctatcatatgggcaataaaatgtgtataagagcaaacatttgtgtatgtgaaataactcaaattaaaaccagttttccacattaattcttacagtttttaaaatttaaatcatttaatgtatcacacatagctttattcattttaagctataaatgttacaatttctgtttaagctgttaatataagctttgtaagagcaattctgtataaatatagaattgtcattattcactaatagctaccatttatttagtgcttgttgagtgcaaaagtactgcactgagatctttgcatatgttctcttaatgttacaattcttacctgaggcatttctgtttctgctggaatatggtctctctgaattgaacaagggaggcatttttggttgttatgatgaaaggtggacactgctggcactaacgtgtgttggtaagcgactagactcttcatgatgcgtaaacagtgtttcctcatacccctgcacattcaaatagaggaaaaccttgtttatagttaatttcccctagaatgtaaatccatttaacatataaacacaaagcgtgttttgtgtggatgttttttactggagcagggagacaggagaggaaatgcagttttgatagttgctgaatttttcaagaatgcagcaattatagaacaatttctagaagtttcctaggagctcttttccatagcagaaaactaggacttaatagccttgcgactcatggtacttgagtgttccatacaactcacctatattcaggggacatttgaaaaattctacattaaaggggattcttaacataggcgcaagtgtctggcatcttcaataggtcttctggtgtggccatgaaaacattcacacgtttcaaagtattttaaaataaaataaaacatatattgttgtgttatgaattattttctttcttttttatatgatggttagatcactgtgcagacaagtttatgagatctattcatttcatttcagggtggtaaatgagggtgttactaaatgttggttctaaaaagggagacattgggtattacagaattcagaacagctctaagccctgtgcacatttagcattagaggacacaggcaaatctggcctccagtcctggcagcttcttcactatgtatatgatgttgggtgggttgctttacctctctagtttttacttttatttctaagctagggctattcatagttctttatcatgtggttactgtgaagtagcaaagcacctgacataattagagcagataaaatgctcaacaaatattgcttatcagaaggattatgtattacctcccgaaatacatcaaaaatatattttccaattcaaagaatatgtagtacaaaaatcatgcctaaattaacagagttgcagtagcccaaggagagaagataatcattattgatttcttcttcctttttgctaagcagttctctgtctctgcctcctcagttgttgtccatcccactcccccactcccaagccctgaactctgaggggtttgctgccgtggccggttctgtagtcattgctgtccaatgatgaaaacacaaaatactgcaacagaacactatgcctgtcagcttagctcccttctttctgctaaatgacactcaatcctattcttttgttctaaaggatatcctaaatgaatagccactggggggaaaaaaggttatataagattgtgcactgtgtgaaactgatgcaaccagatcaatgatgtgaatttctcttaactatttactgggatctagaaacaggtctctcaacttagcagtgtttacgaatataataggccttccttatacatacatctgaagccaatctgagtcaggaagagtcgtggtctgataaatattttgaaaacttgcatttgttctattaaagcaaactgtttattaatagtgtgccttattttttaaagcaaaacatttataaacagtagtcattacaggcacttcagtgtacggagtgatcaattgttagacctttaggaatcgattgtttcgtggagcttcggcttataattgaaatgtcatcagaaggagtgtaagacatagcttcaggagaggccatttatgcgcttttgttttcagctaagttatagagtcatcatgtgaagaaagattcttctcttagtaaaaatcctttaatggttggaataacacttgatatttaatatttctttctactttatatccacatttattcaagtgctaacgcgtgtggggcagcaatgaagcactttattccaacattatagttctcatatctgcgtatgattatttttcatttatcgttagcatatatataatgatgacttttaaagtacactgtattatattcactggaataatgattagctattaataatttgaacactatccaggaaattactgaacatgtcctacaagataaacctcgtatgatattgtctccaaataacagtgctaaccaagaagagtgctaccaagttcaaaagtaatcacagggagtaacctaaatgcagctccgttgggttaaaaatagtttctctaaattatatgttccctaagtttgagatcgatttctacaaggggataaaatgtttttataaattctcagtgataagtcatgtgattaagaacccccaactttttttccaaagacatttgcatctctgatcaaaataacaagatccagtcttagttataaattggggaattttcatcaaaataaggagctactcgttgcataagaagactagtacaacttaaagccaatttaatttcaatgaatgcatgatcagctccattgccaattgagtgtttttcttattcatcagaagatgggttcatcatcgtgtttcatatcaactgttctcaaaccatattgcccatttaaataaatatagatttgtctcgaaattctaaattcatgtcatatttcataaatagcctatggtcctatttattactttaaaatattatagatataatatttttattctaaagtaactgtgttatacaaccaaattattcatttaaatatgtgactttttaaataagtaaatgacttatttaagtaaagtcattaaaattttccagtctgtccttcatccacctgatctttgaatgagttaggaacaatacaggaaactaatacaaacttaattttgattacaaaagatgaaatcattctgttatttattcaacacactatgtgtcaataaaatcttatactgtgaaagaattcgtctaagtccatttgctgttgcttgtaacagaatacctgaaaatgggtaatttacaaagaaaaggagtttacttcttacagttacggaggctgagaagtccaaggttgaggggccacatctggtcagagccttctcccatccaagtactaaccaggtcgaacctcacttagcttccaagatcagataagagtgggcgcgtttaggctggtgtggctgtagacttgttagagcctttttgctcatggggacacagcagagccctgaggcagtgcaggacattacatggcaagaaggctgagtattctaatgtgttcatgtctctcttcctgttcttataaaatcatgaatcctactcccatgataacccattaacctattaatttatgaatggatgaatccattcataagggcagagccctcatgatgcaatcacctcttaaaggcacaatctcccggtgctgccacgttggggattaagtttccaacacatgaaatttgggggacacatttaaactatagcaaaattgtaataaaatgttatatagaagcaatgttcttactgattataattgttatattggtaaagtgttaagtcctctaaccaagggatatatttcagcttattataatagttttaaatttacaattcaatatgaataacatctggtaaaagttcttttcaagaaatgggaaaattagaaatgtttagaagaaaataattcaataaatattaagttcaaactggattcatagtttatgtgaaattctgggaaccaattgcaaggggagaaaatagttacaatagcaatggtgaggatgagaataagagcaggtatcaacgttaattgagggtgtgttatagttctaatcgtgctatgcccactacatgacttttccctgtgtgaggtttccgagcttcttcgtagtaatcctaaattgagctggagagaggctagggtaacttactcacgctcatagagccatagagtagtaaaacctgtatttgaactctggcctgtctgacatcattctgtggtcttttaaaccaccactgcttctccatattaaaactccaaatctaggtgaaaagaagaaaactcagaacatgttctgcaacaaaatataacaaaatataatgtatataaacacttatacataatatcactaatatctttactatgaaaagactctgatacgaacattttacataattcatgcagaagtgttaatcacattgtctgtgatgagctgtgtatgtatctgataaaattctggcaaccagacatcaactcgtaggcatagatctgtaacactaaatatttgcctcgagaaacttaaagaaataaagacaaatgaatgaataggaacatggaactgagtacaagataaaatcctcctaaagcaatcgatgtacttgctgctgcgttattgttctaagcaaaagaagcatggcgaagggagatgtgaagctaaaaacagaatgcttagaaggagatgatagcaggagggaagcaaagatgggaccaagctcccaaaaggcgggctttgaacaaacaaaacagaaagctaagcctttgacggatgcacgggatgcaagaaactttagtcaggaaagaggaggcgaagaaaaaccctccaaagaaaaggtgaacaatattttaataggcaaattgacagatagcaagagatatataccatgctatgttttctcattgcagctgaagacaaactggggttatttatgctttgaaaaagcgtaaatctaaaaaacaattgtggaggaagaagcgatgaaaacacgtgttaatacagaaaacatggctccaaggctttaaacttccttgtgagataaatgcatttacattttccgtagtagctaatatatatatatatacatatatatatatatatctgggaaaataatacacagtgattttctttctttttttcatctacttatgtgagaaaaaagtaggctatctgaaagcttttcagttaaatgaggaagaaagttaggtgatcttgtaaataatatatatgttcaagataatgtaaggcccttgtgtagttttcaaaacttatctttaatagcagtttcttctggggatggggtagttcaaagttgaaatgttagaaagatgttaactttttttcctttttacttctccctttcaggatggaattaacaaatttgattacaaatagatctcagagagaggcaaatgcattgaatccagaagtaacataaaattagatcatgtttagttatgcccgaggtcacatggtgataaaaatgaggataaactgaaattgtctgtgagccagattagtttattttatgccagtcctaggaaaaagacacatcatggtaggatacatcctttttttttttaattatactttaagttttagggtacatgtgcacagtgtgcaagttagttacatatgtatacctgtgccatgttggagtgctgcacccattaactcttcatttaacattaggtatatctcctaatgctgtccctcccccctccccccaccccacaacagttcccagggtgtgatgttccccttcctgtgtccatgtgttctcattgttccattcccacctaagagtgagaacatgcgctgtttggttttttgtccttgcgatagtttactgagaatgatgtattccagtttcatccatgtccctacaaaggacatgaactcatcattttttctggctgcatagtattccatggtgtatatgtgccacattttcttaatccagtctatcattgttggacatttgggttggttccaagtctttgctattgtgaatagagccgcaataaacatatgtgtgcacgtgtctttatagcagcatgatttatagtcctttgggtatatacccagtaatgggatggctgggtcaaatggtatttctagttctaggcccctgaggaatcgccacactgccttccacaatgaacagacacttctcaaaagaagacatttatgcagccaaaaaacacatgaaaaaatgctcaccatcactggccatcagagacatgcaaatcaaaaccacaatgagataccatctcacaccagttagaatggcaatcattaaaaagtcaggaaacaacaggtgctggagaggatggggagaaataggaacacttttacactgttggtgggattgtaaactagtacattcttaacatcaatttattcctaaaagcaatgttcatagggcacactgtaggccatagatttgcctcacaaatttaaaggcctaagccctcaacatgcacagcagtatactcagagactatttgtaaagatgacgattctggaactttttaatgaccccaatcattagcaatgattaaaattaatattcaacattctatatttaccaaggcaataaagtagactaatctattttaaaagggttttaaaatgaagagatgaaacaaaccaaatgattttgatttaaacttcatgaaaacataagttgcattaatcaggtgattttgttttatgagcattctgattgaagtgatcatatttagccccgggagaataagagaaggtaaagtatgggtatggcactgaatttactgagatgattatattgtttgagttaaagaacttgtattaagaaacaagtatgtgccaaacattgtgctaggagcaagcaatgctaaaattacatgggtagaaagagagaatgaaatatctagaatgagttagaaacatcagtgttttccaatgtggagccctgacttcacatgaaaattctcattttcaaacaaggtagtttatgaaaactggactattagcaagacagggtgggcatgccatcagtatagtacctggtgtaaaactagaaattttaatcatttgtgctttcattttataatcagtaaaatccaaggtaggacaaacttttactttttctgtataatggactgatatttgaattatacccaactttaattttttgccagaaattatgctttattgtttctctaaaatggtactatagatctttatttatttctatatatttatatgatttttacatatatgtgcatttacatgtatatacatccataaactatatacatatatacacataaattacaaatatgtgtacctacgtacatatatatgcatatatcacgcaaatacaggcacattttcaatacccctttttgatttttttccttgaagagcatagcatctgaatttattatggatttatttttaatttatggtcatgttctttgagtgcttttggtgtttatctggttgccccaaactcgctagcattgtaaagaagatgtgcaaagcctgaatctagactgactttcatattgactttattagtcaaaaaaagtagatgaaaatgtaacagtccgtgttaaaaatgggaataagacagatgttcaagccctagcttcagcagtttttagctgagatttactggaagaaaacattttctgaactgtaaaacatgcaaaatgcctacgtgacagacttcattaacattattaaatgctatgatatagtaaaagaatttgtaaactgtcaagtgctttgtcaacattaggaatttagttattataggtatttccatatacatgttgtatttagaattccctttaattttatacttagggttgatttgtattttaactaagtcactttatatatctggtcccattatacaagtatacttttccttaggataagaaagtgatctttatatatgtttatcaacccaaatgcccatcagtgatggactggataaagaaaaggtggcacatacacaccatggaatactatgaatccataaaaaagaacgagttcatgtcctttgaagggacatggataaagctggaagccatcatcctcagcaaactaacacaggaatggaaaaacagacaccgcattttctcactcataattgggagttgagcaatgagaacacatggacaccgggaggggaacatcacacaccgaggcctgtcgcgaggtggggggcaaggggagggagagcattaggacaaatacctaatgcatgcggggcttaaaacctaaatgacgggttcataggtgcagcaaaccactatggcacatgtgtacctatgtaacaaatctgcacgttctgcacatgtttcccagaacttaaaatttaaaaaactttaaaaaaagaactgtagatactgatccaaaaaaaatgttcattaatgggggttaaatgattatttctaagtagactactcttgaacccttgaatctttaagaattttctttgctattgaagccattcaaactctattttattaaagctgtcgttattctagtagattttaaacagtaatacctgaatacattagaaatatgcaaatctgcattacatatggcatctgcagagcagaggagtttggtcatctggactcatgctaaagtctccgaaaaatccgcttgtcttaatgatggttgactcgctaatgctatgcgtatatagtcttattttaagtgattgaatgatgtggctaataacccctctgttagatgcactcagaacctcacctacctgggtcctcagctctccagtgaaatctctactttaagtttattttctaacatggtaagagccttcagtttatgttatgctcaggcccgtcactgtgaataaaatattagaaatggactttttttttttgtatttttttaatggatcccttggaactttaaaaaaattatttatttgagctttctactgttatcacagtgtctcctaagcatggcctcccgttttttgttggtaatataattcttacgttattcaaattagtaaccattatttttctcatggctagaattctggaaactattaggaaatcactgagcataattgaatggctgtttatttgaagagctatgtcaaggcagcatagagttgtattttcttgcaggggctctggagtcaaagagcctgggttcaaaccttggctccaccactttctatctgtggggcattgggcgtgttacatttgtgaaacttttgtttctccatttgtaaagtgaggtttgggggatgattaaaccagataactcatgtgaaatatttaatggaaatgtatttggtaggggatttattatttttaaatttggattgcacatgacacatgtcagggatcatgctatgcattttggatagaaagatggctaagatatcatgcctgactcttaaaaacttacctaatggtaaatgacgagttaatgggtgcagcacaccaacatggcacatgtatacgtgtgtaactaacctgcatgttgtgcacatgaaccctaaaacttaaagtataataaaaaaaaaaacttataatcaactgtagtagaaagagatctgaatggcttgccatttagctaggcacatggtatatgtgcttaattcatactagcagccactacagttgtcatgattaataatgagcttccaactgcacagaatgcttttaatccatagaaaatcaaatcagaaacaagtttttgtaaaattaatgtgaaaggagcaacaattaaaatgcaagattgacatttattttctaaattggttctattttctttcacatttacaaaatttataagaaaattctttatttctatgtgatataaagaactagaatgtactttgatgtgaattattgttgccagtgctgttcaacttttatccataatttactaagcacctacatttagacaaaggcattatccatccctttggggaggatttcagatgattcatacacagacctggtctcgaggaatttaagattttctttggggagggaaataaggactttaaccaactcaagagtacttagagaattttctgaaaataattttatcaatgaaaacttgttatattaaaagaaactgtcattctgacttccacaaatctaggcttgaaactatggataacgagatattttctattactctcactcacgtcattttcacaaagtgaaaaggtacattttaactagtgaaagaatagaggaaatggaagtagctcgaggcagtggacgatgattcaaaaagacagggccctattatttgatcaagttatgcaacgactctgggcctgtttcttcacctctggaaggaggaataatctccaagccctttcagactcttttggtaattcacctccagcacatcttctaaatgccagcattaactgtcctctgatttgtctcatgtttttctagccccatgctctcctgttcgccatttaccctcatgcaaggtacaaattacacccatcatcacaagacacttgctcaagtcccattgcccccttgaagacctgccacacctactctctcaaaaaccatcatttcctgaaagtcctatacagctcatttggtatttacagtgtactgccacaagccactaagcatcgttttgtgaatacatgacttacagacttagcttgagtaaagatacttgaaaatgaacaccatttcttggctatcttcctattttgatgtacccttcaggcctatgaattttagtataatagataaccaataattatttcttggttctttcctgcacatctgaataaccctatgcaaagtgatagaatgtttttctataaggaggtcctacactggagattgtgtatttcttaatgctgttgaaggaagagatgtgtatctaaaataaatagactctaacaaacattaatttatatttctattatctgttttgtgtattgagatatctcacaaaaataactaaacattttggcattattgatattacatatttgccatgaatatttgtaaatgaagaaaaatatatatacatcagtaattatcttggcaaactcttcaattatgcaatattgttacatagattacatatctaagtgaacactggagttttaacaatattgtgtgttcataaatgttttatttattattgccactaattcttattgccatttcaagaactatgtataagttgttctaaaaactattaaagtataggtgaccatggtcactactgcctactttggtaaaggccaaatatgtgaagactttttaatgtgttaacaaacgttgaaggttttttaacctgttaacaatcagtaggactcttgaaattatttcctaagagagtaaattttacaacttgcaaagcatgattaacctcttgtaattataaaccatctcttgtagttatgtagcattttgttaatgagcaaagaaccattgtggttcctttttacatttcttaaaataattctccgtaacctcattgatatctccagtaaatttagataagcttttttttttaaaggagggttaaaatgacattttaaactaatttttcttgttagttatacagagttgaactatctgagggttttattgacagtcataaaaaatttgttattttctgtgaaatatagagaatttaattcattatcatattattaattctgtgggccattgtcttaattctagaggcacaagctgttttcatcccactgaaatagaggaatcaaagtatgttccttgctcaaagcacaaaagtgacatactacatagtatgcttcttgagtagtcgtaaatctcatgtgttaaattacatcccaaagatttcagtatgttttatgactttaataatttatggtaatttctaatctggcctttgttgacctgtcttgctttttaaatttttagtttttcgacaaaataattaacatattttaataatcttccaaaggtgtttaaaatggcattgtatagagatagctgaaggcttttgagcttctgtgttgtaaacactttcttaataaaacatgaattgctaccagatgatccagcaatcccactactgggcatttatccaaagaaaaggaaatcagtatctttgaagagatagctttgttcccatgtttactgcagcacttttcatactagccatgatatggaatcaacctaaacgtccatcagtggatgaattgaaaagaaaatgtggtatgaaacagaaattgctgctttaatttatattaaacacactcatattcttctcagctgttaagtattgagttatagatttaaagaattctattgtgaagactaaagtgactattaaagtaagaaattattttttccattatatttaacttatttcatactttaatgttagcgccaatgagcaagactattgaatacaaaaactaattaagtagtggtgatagtacagtatataagggagaacattcttttagaaaggaacaataacagggagcaatagaaacaatgaatgagtgtaaggtcacttagtgttaaaacagctaaaatatagtacaaataagttgcgttttaatagtgattttatataattacaccttgatgttttatttgttacaagaattgtccaggaagatttctctaaagaccaaaggcactcttcccctaaataactccaaagccagtcctgtgtttctataaaaaaaaaaaaaaaaaaaaaaaaaaaaaaaaagtgaaaataacgtgatgaacatttttgaggaagtataaaaccaaaatactccactgcatagctgtttctgcaggtattgtattgatatattacattattcagctttggagtctccacatccaatgttacatcatcactctaaattaaacatgtatagataaatgaaataaatgagatagcatatgaaaatctcatagcccagcccctgcactatttaaaatagaaataccaaagaattgtattcctcatctgaaagctatttagtggtggtgtttcaaataaaaattccatctactgctgttgcttccattgtatctttttctctgcggtactgaaagagaaagagacccagaaggggccttgtctgaagtgtccctcttttaagctgttgctgctttaagcacagggtggacaaatgtaataggagtttcataaaggtggaataaaccagcggattacggtgtgggtgaatactttcagatgttaaccaggagctctgcttgcatgctgggagttgcccatgcctcttctagattgaggcacattatcatgcacaacctaactccaagaaatcttttaaaccactggaaattgaacccagaacatgtctctaagccagccttttcatcctgacaccgaatcatagcatgagccagtctgtcagggatgctgctgctctctaggcaaattttaaatgttgaaataatgaatcatgttttcttgaaaaccatgtacaccaaagaaaagttagtcattttatagatgatgaatattaacattttcttagacaatctgataaattatcagatctcacttttggctctttttaagacagttatgcctcagaaatattaataaacccccaagcccttatactgatcagtatgttcactactagctatgagaaattcttgaagttcttgtaattattgtattatttccttactttcattttattagtatgtgaataatatttttaaaaattctagtgtatgtcttgtatatattttaacaacatgacttttaattaatgtcttgataacatttcttctagtgtatgttttcagtaacatgattattaactgtaactttaaaaacctgtggattagatgggaccattttaaaatgttttaaacctggaaaatctgatggctttaggtttagttcaagctatagatcacctgtggagaatggaactgccaaaaaaaaaaatagctgtagcagccctttgagtattctaaaatagggatgttatccagagcattggtttctaaagcttccattatttattgatgttgagctttcaggatttagctacaatatttactcaacatctaagccatgcttttttatcagtcatgttttatatcttttataatcaaactgcttatcactgaaaaaaatatataagtttctatgtatctggaagaattctctggtgtttcttagatatggattttgatgtgtggaataagaattcaattcaaggataacagagatgttgtcctgaaaaaaatcgaagaaaatcagcttttctttaacattctgtcaaagctcctgactattagtttatcagcactgttttgccaaaggtgtcttctcttctcttctttgaaaaaaatcatctgctgctgctacgccgcaagtgtgttcccgctgtgcctgagaagatgtgtggcataaaaaaatgggcatggcctgagttaaaagtgctacatttaagccagagctggcttatttattagttgtctaatcataggaaaatgacagagcatgcttttctcttgcaatatccgttgctgaaaattaaacacatgagcagagctttcagagaggttgactggcctctcagacagcacctcataggatggcctgtgttgaagcatctcctttaaccagggtctgtccctcagcattgggttggctcacctagattggattgtcccagcagaaaaaaaaaacccaaaattcagaatcatatccaaaccggaatactctttcattcacattacttgtactaccttttcagaaactggatacctgagtgtgtgagggtaacttagaaacttatctcatggttagaagttttagaattagagagcgatgatcatgaaacggacttcatgatcagaagcaatggagcaaggaatgagatgtctttgaggagtatttccctgaggctgtggataacgctgacgaataatccccaccttaaaagtgggttgaccactctagtagctgtaaggtgggagggttctttcttcagagataaatctgtgctcttcacttgcccatttcccaggttttcatgtaggtagaagaaacacctgtaatctgaagacactcttccttcagctttgttagtgacagggatttaaatatgtctttcacacattttccttagatagttaaatttcacttttcctgtttgtttttctctgaaggtattctaactcccctcctaatggacttctagagctttctaattctatgcaatttctgttgatttgttctggtaaactttgaaggtaatctctgattcaacttcttggagattctatcatgtcatctctgtttattaactttatgttactcatggtttcttgatgaggactcattaaacataatgtaagtagaaaattattaactacataatatttactacgggttgttatttctgatagtagctagctgtaagattccaattgttcttcaaatctttgtctcagtgatctctgtgtagttcttgactacttcaaataacttcctagaaggatagggatttaataatctcttaataggaacacttaacacactgctggtgggaacgtaaattagttcggtcgttgaaagcagtgtggtgatttctcaaataacttacaaaagaattaccatttgacccagcaatcccattattgggcatatacccagaggaatagaaatcattctaccataaagacatatgcacgttgtgtatgttcattgcaacactactcacaatagcaaagacatggattcaacttaaatgcctatcaatgaacagactgaataaagaaaatgtggtacatatacaccatggaatactatgtggccatgaaaaagaatgagatcatgtcctttgcagcgacatggatggagccagtggccattatccttagcaaacttatatggaaacagaaaaccaaatactgcgtgttctcacttataaatggaagctaaatgatgagaacatatggacacaaagaggggaataacacacactggggcctactggagggtggaacacaagtggagggagaagatcaggaaaaataattattgggtactatgtttagtacctgcgtgagaaaataatctttacaccaaacccccgcaaaatgcagttcacctgtatagcaaacctgcacgtgtacccctgaacctaatttaaaagttataaaataaacgtatcttattttcagtacaatacaccacagagtagaagggttaaaagagattgcttctgaggaggtgagatgggggtaaggacagcacaagagcattttggggggtgatgaagctgttctgtgtcttgcctgcgatgatggctacacgactaagcccttgtcagaactcacagaactttacttcaaaaggagcggattttactacacatcaattccaataacaaatactttgtctttaagcaaagggatacctaaatatagcgtattgaatggatctccagaaaaacacatttttcagttcatgtttcagcctaggcctcatctcatccaggaaaccttgtcttgcttgcctttacatacatgtggcaatcagtagtttcttttagggctcggactgaacactcaatgaacttcaatcttagcgcttgtcgtagcagattgacatggtttatttatatgtgtcattctctgtagtaaaaggaaaggatcaaggccattcacttttgtagtgattgtgcatggcagtatttggcacatagtagattattaattatggaacttctgttttcacacacacacacacacacacacacacacacacttcagagctattttcatttaaatatttgctttagtctccaaagcccctctgcctcaacaccaacccttctatctcattattcatcagcttttctcctattacgaaactacttaggaaagcccacttatttagcttatgatggcaaaaataaatatttgtacttttttttttttttttagtcatcgcttcatagaacagcctctgtcctctgcttatgccatgtctgaatatatgctggaggtaaaaagagttcctggttgagagcttcaatttgagaaactatctgagattactttccaggttccaccgtggaacctgtctgaccttgaacaaatgacctcgaacaagtggctgaaatctcttctatttcgtcaactgtaaaatgggggaaaaccatgtctatctcatggggttcatgtgaaggttaagaaattgcttattcagtgtttagcacagtgcctgatatgcataaagctcctaggaatattagctgttattgtatttccttaaagaagcccatagctctatatgccctttcattatatgttttagtagcccaatttaacatatggataaaatatttttaagttaaatgatttgctaatggattgttgaacgagtggcagacacccatattatagacgaaggtcaagtccataacatacagtacatttccccactttcatttcccattaccaaaattcattattctcctgagaaactcattatagaattcatgtcagattcatctgtgtgttcccagcagtgccttatatccagaaataacactgagtcattgtctagatgtagcagaggtggaatcctccaaagagaagcctcagagtggccaggtttgccaagtatagggatgccttgattactggccttactctttatgctcgtgaattcctaagttttattcctcctgtagtcatagattggcttttaagctacaagctgaagagagagaaaacctcttccacctcgttggaatatgtctcttcaatccatttgagccaatttaggacatgagactgctcttagtctagaaccagtcatcaggagaattccaggtctgattgactcggactagcgggtcaatatcagggcaaaaattccaacgcacaacacgatgtatcagtaaggagaacctcaaaattatttcttaacgtccagatcatgttcctatttttatatatctattttctcacataagtcattaaaatgatgtacctgtgcgggtcctttaatgatactcaaagatcttgaattataggctaataactaacttaataagctgcagaaattaacatttctgctacgtttatgtagcattttcccacatgtacttcagaggcttgagaaaagaccctgaaataatgactgaataacagctttactcacttaatttcaaatttgttaattcttctgggaaataccgtcaacatccattttattatttttctcaattacatgtacgtttctacatcagtggataagttaaggagaagaattccctcatgataattttttcatgctcgaaaattttgaatcaattttttattttacattatactctttcctagtcattagaaagggagtggtggttaagataggcaagaatgctttataaggatactactctcgtttcaattcttaacatcaaaaaccttaacagtgtgtagactataaaataaaatatctagggatcagagcattgtgctgaactttgcaggttttttagtcaataatatatatgacgtgttcacagaattctttgtcaacaaagtacttttggagctccaggccatttaagttggtttttgtactttttctttttcttcggaagactttttttgttctatttacctggaagtgtttcttttttggtactgtgaattaaaatgagaccaatctactaggcaggaaaaaaccttaattagattgttgacacagacaaataagaatgtcaattagcatctactgtcacatgcctctccagactgcttctaggatgagtggcctcaagcagctacatcatctttatactcctaaagcatcaaggaaacttggagtgacaattcatatcatgaacacatccacagtgatgatgattgtgcttcttcccccccacccaacaacaaaggatgaatgccaattaatgtattcagttttttgcgtcaaaggctggatcacttgtgcaatgagggtaatcatcctgaccagacaggccatacaatccatattgtgtgaattaaagataatatgcgtgaaacaccttactctggatgtggttcatagcagtagcaaaaagatgaaaactatggtatgctaacattttagagatctgtactctattttaaataattttataaaagtgcatatacaataaaaagtgcacgtatcacaagtatatgcctcaaaatctaaagccagtcatgtaatcagcatccacttcaagaaagaaaacaaaacagtacccctggttcctctttgcaatcattagtctcccaagagtaatcaccgatctgatctgtgacagcatagattggttttgccctactatatttttgctgaattatacaatatatgctctttaatgtctggcttcttagtgcattgtatttgtgtatcagctattctcttgtgtgtagttattaaacaatcattttatgggctgcataatattccatagggtaaatataacagttttattgataacttagctattacaaatagtgctgttgcagacatatattctattacatgtcttttggtataagaatttacacatttcacatgggtgtatacccagaactgagattgctaaatattggggcacattgtatacattttgatttagtagataagatattgccagatatcgtaaatgcacagtttgataaatatagagatttatactttttctagagaaaagccatcaatatcagtgtatgtgtatatatatacgcgtgtgtatatatacgtatatatatacgcgtgtgtatatatacgtatatatacacacatatatatacgtatatatgtgtatatatatacgtatatatatacacatatatacatatatgtgtgtgtgtatatatatatatgaaacaactcagaagcagaaagataccccatgttctcacttataagtgaaagacaaataatgtataaacatgtacacatggacatagagtgtgtagtgataagcattggagactgaagtgtgggggtgtgcaagggaatcagtgataaattaatggctacaatgtacataatttgggtgatggatacactaaaaatccaaagttcaccactatccaacatactcacataataaaattgcacttgtaccccttacattcatacaaataaaaaattatttaaataaaaataaatatgtgtatatgtatgcatacatacatatgcatatacatatgtgtttgtgtgtgtgtatataacttacacttaaaataagcatggatgctgcaatgaatgctcaatttacaagggttgtccatccaaacttgtggcaagtatctcacctctcaagttgttttcttttttcttcatatatttcttgcttttgtctaggaaggaataatttggcttgcctttcaagagtgtacagtcagcatgataacccaaacacttaagacacgtgctaacccatgtggatcccttgagagaaggaaaacagtggtccttttactgggcagatagagcccggggccaggtttcgtggcttgaagatttcagcttctctgcgcctctcagctcagtgcctctggaagcaatttacaacttgtgaggccatactcaaaggccctgttattaattccccgccttccgagaccccatttcagaggatctcaattgctctcagagtgaatttactgtttcctgaattccgtaatcccaatagcaggtctgttgtcctcattagatagcttaagttagagtcggcagtgtaattggcaactgagctactaagtatccaatgcttatgtggaaaatatgttccctattgcaaacaactgatattcatattcaatttggcaccatcatctatctataaagcagatactacttgtgtttattaagttttatcccaaataattattttagtaataatgcttgaaaataggccttggtcatttgcatgtctgtatatggcatatcctgagtctttgtatgtattagaaagatcactcgttttgacttgatggtttaataaaagatgtccctcactttgggcagagacatttgaaaaaggcactccaaccagggacctaagaggtgaatgagatgcagctctgaatcaggtcacacggcctcaggaaggaaacatcttggttttcacatccctcacttctcgatgtcatgtgcaatacacaaatgacccctcaacacacacacaggcacatacacaaacacacactcactcactcactgtattgtctctttccttgactaagtccttcttactaactcaagctctaaagcttttttacttacctaaggtgagtgtgtgaggatttgaggtttcaatattaaaattcagaaacatttaaagttcattttaaatattagtaaaaaaaaatcttgacaaaatacaattatagacaaaaagaaaattcagaatatttggaatttaaggttgaggttacagccctatttatgaaatattagaagaaaaatgctggagagaataaagcaggtttatgagtctgatagaaagcataaccagatgattatgcatatatttgcatatgcaaagctttctaggcaatctgaacatttaaacctacaaatgtggctgcgatgaacagccacagaagagcaggctagaacagaagaggaggctagaacagaagagcaggcagaagttgtaaatgaaatgttaattttcaatggttgatctcccaagtactggaacagatttgtgctgttttcaaggttttggttcaaagaatccagtagtgtattgaattgttttgtggcacttccctgttattttgctttgtaagctacctcaatccatgaagtggctatgagccccttatacaacactgttgatttttttttccttatctacgcaaaagatttttgattcagggccaggcatggtggctcacgcctgtaatcccagcactttgggaggccgaggcaggcggatcatgaggtcaggagatagagaccatcctggctaacacggtgaaaacccacctctactacaaatacaaaaaatcagccgggcgtagtggcatgtgccggtagtcccagctactcgggaggctgaggcaggagaatcacttgaacccggtagccgagatcctgccactccactccagcctgggcgacagagccagactccatctcaaaaaaagaaaaaaaaaaaagattttttattcaggtggctatcagactcattaaatagaagccttaggttaagttcacgggttgctagttggaagcctccatggactatgttcataaaataatagaaaggagttatgcaggacttcttgaaatgttatttaaaaagtcagaataggctttctattacttgtctgaggtcaaatacatgtagtgctttctgaccatttcatccagggtgttagctaggacaataagaggtgcttaaaaattattagattgagtaaatgagaaagcccttagaaacataggaacagaatgacccttgctttggatctaatattgactcccacgcctaaatccctttggagaactcctttattttctcttccatcaagagcaggtataaattaaaaacaccattaaaggggccatctagctcagctgaagctttcatcacacatgtaggggaggtatggttgggagggatctttttatcctttaggtcttcaatttacataggacttttgaataatcaaatagccccaaagagctgatcttaggactagttgtaattgagactatttctccatggggtagaaaaatctagttgtaggaaaactgagaagtagatgtatgttaacctcaaaggctgttttttacaaaggatgttaaagcatcatctttgctcagaaagggagcaataaaacaaatgagtggaaataacaaaaggaaataatggccaggtgcagtgcctcacactagtaatcccaacactggggggctgtggtgtaaggatcgcttgaggctagcagttcaagaccagcctgagtaaaataggcctcatctctacaaaatagatagatagatagatagatagatagatagatagatagatagatagccgggcgaggtagtgtgcccctgtagccccagctactcaggaggctgagatgggagaatcgtttgagcccatgaggtcaagtctatggtgagctgtgctccctcctgccactgcactccagcctgggtgacagagtgagatcctgtctcgaaaacaaaaggcatactttttagatgtaatggaatagagtacttccaaacctggctgcctgctggagttgtattggaagaggttgcacgacttcagtggagatggcctagatgcctgctcagcagtcatctagttaaagcaactaagaacatgtaatatgaaactgcaaaaagagatcgtgtacgtaaaatcactctgggctcctcagatagagtaataaacacaactcctgacagccaaataaaaagagaaataatacagcccttgacttccttggttgctttgacatactaagtaggtgttacaggttgggttctctgggaaacagactctaaaacatttttatttttactttatttgttgttattattattattattattattttagacagaattttgctctcgttgtccatgttggagtgtaatggcacaatctcgtctcactgtaatttccgccttatgggttcaagtgattcttctgcctcaaactcccaagtatctgggattacaggcaagtactaccacgcctggctaattttgtatttttagtagagacggggtttcatcatgttggtcaggctggtctcaaacacccgacctcaggtgatccacccacttctgcctcccaaagtgctgggattacaggcgtgagccactacgcccggccagactctaaaataaagtttaatatgcagaatacttatcagggaatgcccactggaccaatacatattcaagagagggcttagaagcaggattggacagaaagagaagttgagctgtaatgcaggcccaataacagccttagtgttaagcaggctgagagattcagcagttaatgagacagtcaacccaaacagttttataggcatcaaaagtatgatcagcatggtgtcagtttcctgtgtcacttgtcccacagtatgataccaaaattaaagagaccagatgacatgcaacacaagcagtgtgcactctgttgttgagaagccaatttcgtcatgcaattaagcagttttatactctgcagctgtactttaaggggagctgagatggaacatcatatgtctcaccataaccagaaaggcagatgagaaatgttctatcgccacctcccacaaggtaagggacttccctaaagatacagaggtgggtggaatattgccttggtagacttcctctcaagactgcctatcttcccatgttggaaggatcacagagcatttgtcaagacgtgggtcaatctgcagttgaactttgtgtatgtggcctatgtggatacttataatatcattgggcacctccatagagctgtttcccaattgaccaaacatatgggaagcttcagagcttcgaatgacccttcagagtagtcctgagaacagtgagccttactactcctgcattaatcagtcattggatgatagccttctcagaaataagtcatgaccttgtgcaagggggctcttcatggctgggaccacccctaaaactgagagctgaaggctgtctgccaccagcccttccacctgctgggacaagttctttattgaagggaaatctgagtagttcatcagcgtccatcacagtagtcaagccgttcattcttccttcttatgacaacattgtgcttattgttatgtaatccctttccagaacattttaggttaagttttaaaaataatgcatataaatagacaattcaaatactggggaaaaaaagcttgcacttatattgttatagaaatgtgcacacttaaagagctgatttcttctgggtatttacataactttatttaaaaatccatccatttttaattagctgtttttaatatgcagttagctaagatattataagccatatattaggctaatggacatttaacagcttagttaagttcttttaatggaaatgctgacaaacctttgtctgtaattatagcaacactgtgattacagaaggaggtgcctctccttgttgtttgcagccctaaaattccatgtggctataagtaacaaagtccattattagataaacacaagtcatacttggcattacttgcattactcgtctccttgctttatttgaatcattttttaaagttgtaaaatgtttttcaaaactcagaatagtggccagttaataatatgattcctcttatattatgagattttaaaaaatagttcaccagtttctggtggcctctatacccattggcaagtcctagccattgtgaattaagtaaacaattctttatggaaattttttaatccttaaaccctataagtttttattcatcatgtcaggtcacttgtcaaagggtttaacattcagaattcaacaaaagtttatcaaacacctattacaggacgtgcaattttgggcgcactgggatttcagcaattaacaatcaagatatgatttgtatcgacatggatattacattctctcacaggagacagaaaacaaaataactagaaaatatacataaagagactttaaaatggggtaaaattacagattgtgacaggatgaccactttggttcagaatatctaggacatttttttctttttttttcccctccctccctctttcttttttttctttttctttttctttcttttctttctttttctttctgcctttcggagtcttgctctgttgcccaggctggagcgcagtggtgcaatctcagctcactgcaacctctgcctcccatgttcaagcttttcgtgtgcctccgcctcccaaataactgggactagaggcatgcaccaccaggcccagctgatttttgtatttttagtagagatggggtttgaccatgttgcccaggctggtctcaaacttctgacctcaagcgatccacccgcctcagcctcccaaagtgctgggatttacaggcgtgacccaccaggcccaagcaaggacatttttttctgagccatgttatttaaacagagatctgaatgacaagaaggggccagctctgtgatgtaggggaagaaaaatatgttccttctacccttctaggctgcccagctggagtcctacaaagttagagtgacaaaagacagattaacaagaggaaaagcctagaagtttattaaaatattcagtgcacatacacctggtagaaactcagtgatgagtaactcaaaggggtggttagaatgttgggtttatatagcatctgaacaaagaacagtaaacttgtagagaaatgacaaaacaaagaaaaaaggggtttaggtatttagggttgccaaactgtaggaaggtaaatatatgggagaaacatggagtatagtttgtttatgccaagtctatcttgagatcaacttttcgtattcttcatggccataacaatttcccaggagagagggcttatagcagttatcatttctcagaagtttctgcttttatttagacaagggaagcactgggaaggcttctttttgcttatattgattcttacttgcctctaactaaaagtaatctttatgtcaaagtgccatattttggagtggtatatattgatctcctataataacaatcaaaaggaacagtattctaggcaggagtaccactaatgcatagtgtttggtgtaaagacaagttaacatattcatggggcaacaacaacaataagccaatatggctaagacattgaggatgagtgagttggagaagtaggcaatggccagctcatataaagacttgttcgtttttataaattgtttagattttattgtaattatggtggcaagtgattggagagtattagcttcactttgactggcttatcgaaaacggaatgtagggggtgaaagtggaataaaaagaccagtcattaattgagtagtccgtgtgagagatgatagtggcttggacaaggacgattgtactggagagattgaagcgactgatttcagatttgtagtcaacaaggcttaattggtaggagaaaaaaataaatcagtgttaactctttaatgtttaacttgaataattatgatgagggtattaccatttattgagatgtagaatattataaagtaagagcagatttgttcaaaaagtatcaagaatctttatttggacatgctagtttggggatgcttattagagaccctaggaaactgaatataaatgtggattttagagaagagcttagggctggcagatgcacattaaggatctgtctagagccatggcgctagagacctccaggagaacataaatagtctcaagatcaagccctgagacactcagatgtttagaagtggaacagaagagggacatccaatatagaataccaagaattaggaggggaatcaagagagtgtggcaatatgaaagatacaaaaagagtgttgaagggagggagtaattaataaccagcatgttatgaggggctcagtataatgaaaagataagtgactattggatttggcaacatataattttttggtgatctggacaagagcaatttgaacagaatgatggatatggaaggtccagaggagtaggctgagtaaataatataaggtgggaaaatagatacaaagattatagacaactttttcaagaagttttactgtgaaggggcacagcaagctgagacagtgaggataaataatagactcaaggatggtaactttagaataagaaatttcaatctgatgggatttaagtgttagcaaggaagctttaagaagttattttccccattagaatgatctgaaaaatgttttagaacattcctcttatattctattttatcacatttatataactttcagagaattgaaagaggtattaagttattatgaaattttctgagattaataagataacaattataggatgttttcttttagttgaaatacacctactcagcctaatttttataacttcttactgaagtataatatacttcagtagaaaagcatgcctaatataaaggtgcagctagatgaatttgcacaaactgaacacatccctttaaccagcacttagattaaaaacagaaccttgatgatacctcagaggcccccttctgccccttttcagtctctccgtgctacccccatggataagcattatcgtgatttctaataccatagattaattttgccagtttttgaattttatgcaaatggatctatttcacctaattgtaaatatataacattgtcatagcaaggcactcattgccttacactgaaaattacattgactctttgccacaagcttagacttgctttctcattttattatcatcaagcctatagctttcacactataccttgttcctgctcttccctactctatttcttggtagatattctatatcagtcttagagtgcagtttgcagaacccctccatcagaatctcctagggagcttgttaataatgcagattcctaggcccctcccatggtttatgaatctgagagtgaggcagacaagactataccctctcatgcctctataatgtaataatgtcttcctagaatgttctttgctgcatctcttattaaagaaatcttatgggccgggcagggtggctcacgcctgtaatcccagcactttgggagcctgaggcgggcggatcacatggtcaagagatcgagaccatcctggctaacacggtgaaaccccatctctactaaaaatataaaaaattagccgggcgtgctggcaggcgcctgtagtcccagctactcgggaggctgaggcaggaaaatggtgtgaacccgggaggtggagcttgcagtgagctgagatcacgacactccactccagcctgggtgacagagcgagactctgtctcaaaaaaaaaaaaaagaaagaaagaaaaaaagaagtcttatgtttcctttatggccagagcacaacattgtcatgaagtcatctaaaatttcccactagaggtaacatctccttcccctgtctagctcttttaaagcattacctccatttgccttgtatcatagctgcttgtacacctgtctgtctttccgctgaggttataatcctctggagggtcatgactttgcattcctttgtgtctcccattagcagccagcacagtgccttgcatactgttagttctaaataacttctctctctctctctctctctttttttttttttttttttttttttttttttttttgagacagagtctcgttctgtcacccaggctggagtgcagtgcaatggcatggtcacagctcactgcaacctccccatcgtgggctcaaatgattctcctgcctctgtcttccagtagctgggattataagtgtctgccaccacgcctggctaatttttgtatctttagtggagacggggtttcaccatgttgcccaggctggtctcgaactcctggtctcaagcagtctgccctactcggcctcccaaagtgctgagattacaggcgtcagctgctgcgcgcatccctaaataaacttttttttttttggcatgaaatctgtaacactggaaagatgttattgccttagaataattaagagattaaatgtagaatctcaaaaacattcatttttttccatgaaaactttaccaggcctcaagggataggaaaattatgggtacagaattgagaatctgtaggaacttgcaagataaacaacggtttcacaagaaagaccttgttggagagttaaattttcagacagttgtaataacttcacattaaagttttgtcaaaaaataagtatctgcatgttttgtttgccttccaatgccctcattttatttgattttttcccataagtaactatagtgaaagcacgaaaatgtgtttctgtgtttgtgtgcctgtatgttaattgtgactgtttctattgcattgttattgcagaacctaggcacgcactctgtaggcttgggtgctttctccaactgaaaaaaatcctacatatggataaattatttttacagccagtgtttaattttacaagtggtccccctccttctgtttttaggatggcagagagaatacatatttacttaccattatcacttactcatgctttgagcttgaaggaaatgagacagaaaaatgaagtaacattaacttctctctggaactatgtttctcatattagagctttatctgaggagttcacttcctctctcttcaatgctttgttcctctccagtcgattcaaatgtcctcttaaagcagaagttccgaacctctttctgtgacttcaggagagcatgagaatgtaaatataagttttaggactaaattttcaaagactttttccactcagctctcttttcctcttcggtttgttgttgtcgttgttgttgttgtcgttgttgttgttgctgctgctgctgctgtttttccccttccacttccgtaactgagctcttagggtccatctggaatctgattgcaattaaaaaaaaaaaagtttatttttacctccttgtacgtgctttctcctaaagcaggagtcagaagccttttttctttgaagggctagttagtaaatattttaggcttgtcgtctttgtcgcaattactcaactacgctgttgtagtatgaaagcagacaatacatacctgaatgagcatggttttgttcctagcaaactttacgcacagagaaatttggatatcgtataatttttatgtgttgcaaagttgtattattcttttgatttctccccaaccatttaatatgtaaatcccattcttagcttgtgtgccatacgcacacaggcagcaaatgcgagttgtcacacaggctatagtttctgactttatgtcttaaagtaaacagtaataatcattctctttttccaaacagtccactaatctccctttgtattcagcccttgcatagtaaacgccgtttcttcatcatcctgatttttattctgagaaaatactgtatattgttcccatgcactagggttcggggaaatttaaaaggatgtaggatctccttttcattggtcctaaaattgcactggggaggcaggtcatgtttatgaacagataaatagtatcataatataatcatgcatttctatggctagcatttagaactatagcttttgatgtcatgtggtttttatatggttgattatttttttcttatttataaaatgaaaaagtttgagaatttttcatctccttaatgtattcccttatttgagggaaaagtatttacctactacataggaatttatcttaaaattttctttgtctatctatttttatggaatataatcgagcaactattttactaattaatactttaatatcattatgaaaatgttctcatatttttaaccttataagatcagataattgctatgccaatctatggttgaaatgggttcttatacttaacgctatgctctttcttctgagatgtaaaaatatgtttaaatcagaatttatataggtgtcaattcaaaatgacagtagttcattattttgattagtataaatgttcacaactaattctattctcttatctattaagtcaccaaataaagtatatttgttttaaatatttaacagtttaaattattctttgaaaacttatgagtctaaagtaagaacaattaacccattcattttgcaagtgggatagttgaattttacttgcaatccagggatttttgacagtttgaaatatacatacataccatgtatgtttaggaaaacatttaaaaagagggggttgtaaaataataatagttcttccatgattttttagccataatgtttataatataaaatatgtatactcttgttattgaatgtagtatgtttctaatttaccagaaggcaagagaataatcctggagaatttctcaaggcatcttcgaactctttgatttattgctcacatatagtaatttgccaaatgacgccctagtgaactgaaagaattaatgccccgtcctaagtcactttcaccgagggactgaaaacctgcagcattttgccaattagaggaggaaacaatctaccttgcagagtcaggagtactggataaaggagctaagagtgttgctttttttccccttcttactttaaaaatcccaattcatcccatgtctttcttaaaggctaagtgaagtagtaagtacgtttttgcaacatacgaatttagcagactggccttgtgtttatttttggccggaaccattacacttatttccaaccctctcctttatttgttggttgataatgggctaattttgaatctttactgtcaaaagaacattaagagaagcagccctgcctgcatcgcaggctatgtctgtcctttgccgagtattaaacactaaaaaaaaattaagaaaatactaacaaaatgacaaagcattaagaaaataaaactagatgttaaaggaaatgagaaaataggaaaggatgctgtacctggagtgattttttttccccaggctacctaagatgatcaaaaaagagctaatttctcttaggtttctattaaggaattactagaatatcgggcacaccaggaaactttatcagtggacctgtcctgaaccaaattttcttaatgtatatatgataatttgttaccacatcccagattattttacaggaattaaaatatatttgaaacactgacagggaaaattgggtaagacattgatagatactacaatctgtacttgaaactgcactcaaggaattcgttagtcaagaaagaacacaatgactgtgggcccctctgggttttggaacctcttttgtaaagcatttttttttttcccaaatagaagatattatttttgaaaaggttaaataaaaaatctttgttcactatatagtttcctcctaaggagtaaattaatttatataaaatattgcaatataaataacaattttaaaatctcaaaagagcagtgttttaaaaataatgtagaaacattaagaaatgacttcaaatgataagaatgtcattggagagcaaagggtttttaatattacatatcgtggcacgtatatcagcacccaaccgctcaagatacagagttctttacaaaaatcaaacagaaggaaatgtgccaccttgttcataaactatatttaataataagccaggcagataaagtcactttcacaaataatgagcaagcccatggtaatataattcatttacaataagatttatctcatggaattcttagactgtgctttgaaatttaaataattctgataaatgccaacagaatagagaaatcaattccagagcaattactaacacgttgcattacctttctaacattaatatttctcttcatacatatcattgaagagaaaatgaggatggaaaataaaaagatcaggtaatatatttgctttctcatctagggttgttatgatcttcaagatgaagttttattttttactcctagcaaatgatattcttttttattttagtttttattattttatttttctgtaaattattggggtacaggtggtatttggttacatgagtaagttcttttttttgatatttctgagattttttttttattctactttaagttttagggtacatgtgcacaacgtgcaggtttgttacgtatgtatacatgtgccatgttggtgtgctgcacccattaactcgtcatttagcattaggtatatctcctaatgctatccctcccccctccccccaccccacaacaggccccggtgtgtgatgttccccttcctgtgtccatgtgttctcattgttcaattcccacctatgagcgagaacatgcggtgtttggttttttgtccttgcgatagtttgctgagaaaaccacgaggtaccatctcacgccagttagaatggcgatcattaaaaatcaggaaacaacaggtgctggtgaggatgtggagaaacaggaacacttttacactgttggtgggactgtaaactagttcaaccattgtggaagtcagtgtggcgattcctcaggcatctagaactagaattaccatttgacccagccatcccattactgggtatatacccaaaggattataaatcatgctgctgtaaagacacatgcacatgtatgtttattgcggcactattcacaatagcaaagacttggaaccaacccaaatgtccgacaatgatagactggattaagaaaatgtggcacatatacaccatggaatactgtgcagccataaaaaaggatgagttcacgtcctttgtagggacatggatgaagctggaaaccatcattctcagcaaactattgcaatgagtaagttctttagtggtaatttgtgagatcctggtgcacccatcacacgagtagtatacactgcaccatatatgttatcttttgtccctcggcaccccttttctaccccccaagtctccaaagcccattgtatcattcttatgcctttgcatcctcatagcttagctcccacgtatcagtgagaacatatgctgtttggttttccattcctgagttacttcacttacaatgatagtctccaatcgcatccaggtcattgcaaatgctgttaattcattcctttttatggctgagtagtattcatatatatatatatagacacacgtacatacatatgtatatataccgcagtttctttatctacttgtcgattgatgggcatttgggttgatacttgcacacacatgtttatagcagcataattcacaattgcaagtgatattctcaggaagcatgatgtaagtgacagagacttactttgtagactgcactcattcacttgttctctgaatgtgctctaggcagcctgagtttctactatgtcagtgttacatagatgagaaaccccatgggtggtttccacagaggctgcaatactatttttgataccaaaaatctgtttggttttgtgagccccagatgcccatatggaaaactgaagtgttgatacctctttgtagccctctgatgaactgcatggttcaccttcctcagcagtttgagcggggtggggagagcgcctgcttcctagccatccgattggcctgaatcatcaaaaatgctatcatgaaacaggttctgtttatctgctccagattacacccatcatgttctagagtgctggtttcatgcttgaatctagatcaagcctgctttcctcccctgcctgtactccctgtggctacctacagtcctgctgctgacagataatctaaaccaatagcacctaattagcctatttgctcatgtgttttttccatcgtggtataatgtcctccttgtcaatttagggtgaaaatgtagcaacacgttgctgatggtttaatttctggaatgcaggtaatgaatgtgtttttgcttatccaagtcttcccatcagatgtcaaatatagaagaacagtgttcagaggtcctaaatttaaattggagtgagaaattcacagcgcccctgaactcaggcaaaatgcactctgacaagtcaaccagatattcacagatggtctggaggatttgaagcctaatttggtgaaataaaattaaatgagtgaaattgtatgcagtcattaatctatcaccatacttaaaatgcttcattgaaatttcttttactgcttcaaatgaaaaaagatcaaactatgttatagaaaagcattcaaaacccttacataacatagataaaacttggttggagacttacagaactttctctgctgcttcgagaaagttacagtgcccacaaatctattgctattagaatattttattgtattcaacactcaattctaccataattatgtatatgagaaaaatatttttacctataaaataattattattaccttttaaaaatctgacattcttccttttttctaaagaaacatatttagatttagcttttattttatttttgtgttgatacatagagattgtacatatttctaagattctagtgatattttgatacaagcgtataatgtgtaatgatcaaatcagggtaattgggatatccaccatctgaaacacttatcatttcttcttttcaatgccatcataccaaaaggaagtaaatagaatttcaaatataaggacagccatgattttacatacatgcctacgattccaccacaaaccataattacgtcccccaaacttttaacatttcagatactttgtcccaggtatttcatgataaggattgggctatgactctgttacagaagggccaaatgactaaaatgtctctgaacaatattgattgcaaatattctacccagttgtcaggtcaatatgttccaattcggaatttataacattgtatctctactcccaaaccatccaatctcacctacctcacttccatattatggtgggtgatctcagattatatttaagctcatggttacttgtcaagtagatatggagtttagcctaacttttgaaatttatgctgagattacccttctcattatagaattaagtaggcagtttccaagtttagatttagcaggcagtttttttcaaatcacttaaaagttatatttttttagggcattgaacaggtttgaaatcctaccaagatgtcatgtacacatagaccaatagaacagaatagagaacacataaataaaactgcacagctacagccaactgttcgtcgacaaagtcaacaaaaaaataagcattgggaaatggattaaagatttaaatgtaagacttcaagctataagaatcctagaataaaatctgggaaataccattctggacattggcttgggaaagaatttttgactaagtccttaaaagcaattgcaaaaaaaaaaaaaaaaaaaaaatgacaagcaaggacttactaaaataaagagcttctgcatggcaaaataaatgatcaacagagtaaacagacaaacaccaaatgggagaaaacttttgcaagttatgcatctgacggtggtgtaatatccagaatctatgaggaacctaaacaattgaacaaacaaaaatcataaaacatcatttaaaaaatgggcaaaagacatgaacagacatttctcaaaagaagatatacacgcagccaataaacatgaaaaatgcgtcacatcactcatcatcagagaaatgcaaatcaaaaccgcaaggagataccatctcacacccgtcagactggctttgttaaaaagtcaaaagacacccaatgctggcaaggccgcagagacaaggggatgcttatacactgttgttgggaatgttaattagttcagccactgtagaaagcagtttggacatttctcaaagaacttaaaatagaactatcatttgacccatcaatcccattactgagtagatatccaaaagaaaacaaatggttctaccaaaaagacacatgcactcacatgtttgtcacagcactatgcacaatagcaaagtaatgggatcaacataggtgtccgtcaacgttggattggataaagtaaatgttgtacacatacaccataaaatactatacagccacgaaaagaagaaaatcatatcctttgcagcaacatagatgcagctagaggccattatcctaagcaaattaacataagaacagaaaaccaaatactatatgtactcagttatgagttggagctaaatgttaggtacttatagaattgaagatggcaacagtagaaactagggactaatagaaggggaaaggaaagggggagacaagggttgaaaagctgcctattgtgtactatgcttactacctggttaatgggatcatttgtatcccaaacctcagcatcacgccatatatccaggtaacaaacctgaacatgtaccctctggatcttaaaagttgaaaaaaaaagatgtcatataaatattcgtggtcactaaaagtatctaatgtattatacataaaaataaaaattgggtgaattggaagtgtattctttgtatcaagtcatgtcggagatcctattctgctttgatcacagtgtgaattcttttgcatttttgttaccagtcacttctttatttattgaactaataattacatattctgataatctgtcagaaagataaaaacattctttgtccatgtgtctgaaaatttttaacctatttttctaatgttttaagtgagaagagcatgttaatactgaaattgtaagcagtagactgaaaaatcatcccaatccatgggttatatattgaattgcttttaactgtattactaaatattaagcttaatttattttatttctacatatccccatttccactataggtgatttgtatgaatttaggaacttccttctctcatccatttttatattaaaactcagactttctaaaacaatatttctatccatccatcgttggtaactatgtactgacatgttttgtgcatccgaaaaatgttagcattagtttgtgcgcacagaagtaattccagtcaccatatgatgagctgatttatttatttcgtaagtgtgttcattattattatctcttcagcacccaaatatataggggacttaatgatacctacaagtaaaaacggaagacaaaaacgccctgctctctacagaggttaaaatgtttttgcaacagggctctagatctcagctgtgaaagtagggacgagatgaggctaggcatgcagtgtcagtataatacaatataatcaacatgtcagcatctaatgcaggtgttgcaaaacaaaatgtacacatgggtagtcaggtaacagaaaagcatgaagtagtaagggctatctatgcaagaggttccaagctgactatatactgaaatatttaaacactatgtggggcaaataaaatggacattagaacagttcgatggtcagttggggacttctgctctttcttccagtctctgaacatatcttaaagccacaatcatctatttttatttattgttatacatttatttataagccagcacccctgtgatttaagttctgttgaaatgctgagttggaaaagatcgatggatgggggaaatttagtgcagaggttttgccccaggttcaaaatcctttataaaatattaatacatggaacaaatattgaacaattaaaccactgataagttaatcaatctgattcaaagtacacctgtgaagagggacatggcaagaaaaatattacagtaagaactagaaacattccttcatggctgcttgatatggatatgtcatgtttaagaaaattcttctttagactgttgagattttttttcctgacaaagaagattcactgtcgaggaaagaaagaggtactgtgaaatttgttattgaaaacatgcacatacttttgtcagaatgagttaaagagtgaacaaaatgtgcctattacttacgtgttgtgctgttttaattcaagattaaaatatttaacgtccacagacaagaccacttttatatgaatattatttttctgctttattgctcaattttattaccatttcaaaacacccgtgttgctttctatggccaaagatgtttagcacttttcatggttatacttctgtacagtccaaaatacaacacttactttacacatacacaaacatccaatgtattttgttttctgtcaagtaaagacaatgtctgtgttattaagttaaatgtcactttcaaatacaggatatgttgatattagaatgttcaactttatttcctcatttaagcaaattacagtgtgaagaatgtaactgcagcaatttataaaaatcatatcacattcaattatgagagcaaacttgttttgtagacttgaactagtttcaattaatcttggagttatcatttcaaaaattctaaacagagagaaatacggagtgtaataatggtaggtctttgggtaagctgcttccaggaaaagaaagcaattatatatgttcacatagcactgacaaggagaaacaaaactttggacggcaaagaacttgcattagtctttttgacatgttcctgtggtgtgatttattacgtagacaatcagctcaacttctcaagtttgatatccttggaatcatttgaaatttaaattttaatgaaaattcattaattccaaggccaaaagaagtgattctaattgcttttgagaatcagactatgaaagaattctttggcaaacttgcactgtcttttctcttttatcattggttgcttcgtaggtacttaattgaaggtcctctgattatcagcacgggctgacatcagttcactccatgcattttaaacagtaggccagatgtttaaaggatcagctgaagcatcgatagcatgctagggtgaataataaaattttcattatctacaagaagcaaataaaaagcataagcattttcccccattatcctgaaggagaagatgaatgcctaagcaacattttaagaatgggttgagtgtggcctgtgggaaaatttgggtagaaaacttgtagttagctaatgtatatactgtttgcctctttagctcaccatatacccacacacatgggcatgcatgcatacagacagacacatacaatacacacaacaaacaggaaattcagatatactgaagaaatgtatttaagggattactaagtttttgtaaataaaatcctttaagatgctgagaaacaatggaagagaagtaggacatgatggctcatactttcgtaatttacttgtttaacgtttgccaaggtttaaattaatgtagatgtttttgtggctaggattaatgatctaacagtttggaataattaggcacttttatcacctagaaagcccagaaacccagcatgcaaaaattctggtatgtctgcattttacacttagatataacagagaaatgacaagtagtcaagtggatagagaaacgaatgattcttcacacatgcacacacacatagaaattgtctttttaatagtattttaatgtaacacatttatgcataatttctccatagtgtttatcttatagtgaatatgtgatgaatagtctctaacattagtggttttatagattaaacataattaaggctttatatattaaagagtcaattggtgacattctaatataaacatgtttatctcatatacattgaaatattagataattcattcgttgagaataaatcgaatgagtcaaaacttttaacctccactttgagctttgtaatagtatccactgaaaatattcatgaaaatttttaagtcatttctatttatatattcagtccaaacatctcacaagtttaaaatgtaaactcaagaatataatttctgtattctacaattggaagcatccatcatatcagatgaacttatatagtttgtgaaattttgcaaactttctgtttagtaaatcttaatgtcaaacattttaacttccaggttgtctttcttttcagttttaatatccgcgatctttgtatactcgttgaatggattctcaataagtaacccacaaatatatatacatactatgtacctacaaaaaataataaaaagtaaagaaatcgacacttatccatacctgtcccatagtaataaactattcataagtatatttgaaagatatgagaatcataaaagttcgtgtttgcacccttttgtgcgtggaatcctaggtttgcattttgtggatctagactttttggagtgtggaaataaatgaaacaaataatcgagacccagtcttatattcaggttatcattttactacataaagcataaataacatttgcagtttgtttctatggctagctctaaagtcttagcaacgagaacattatagaaagacttcaactgtagcttccagcagaacttctgaggttccgtttatggactaagcagcagttgagggggacaaaactcataggcaattgatcactccaaaggatagattgtcttttctaacctaatcaaaagatttatagtgaaggcatattcagattttgttgaaggatatggatatataatcatgtgtgtgtgtgtgtgtgtgtgtgtgttagacatacttaaaacattatttgagtagaaaattctgcacaaatggaaaagtataacatgtgttatatccacacatgttgagcatttacctggctgaaacatcaaaagctgaattgacttaattgaatgttgaatacttaatagttactttgtagtgactcactattaaaacattatctcaagctttgtcagaattaatttttttaaaaaactcagattagtgtcaggtttactgaaacagcagatctgaaattactgtgtttttttttcctttcaataatcagtttctaatccaaaattgaatatcagttccaactctacattcagtttctgttttacttgtttggactggcttttggttctgttttccacatagatcctctctgtgtaagacaaagccatttgtgcagattaaattttactgagcgtgttaacctatttaaaacattcatccaaaaagactagtatgaattcttcatatggcaagctgcttgttttaaaacttccatttattctaaaatcctttttacttatactttttaagaaacgtattcccgatatacaaaagtaacacatgctcattaaaacaaattaaaaatagtattgtataaagagctgatacatttctgccttgccccatttaactttcttaagtgttcatgtgaatcatccattcacatcaagacatttatctgtattcatatgaacgtgttttaatatatataacatatatagaattttatataaactttccttttaaaatagaaatgaaattatatgatatatttattctgtgtctagctcttgtcacgtaattattcaagaacatatttctaggttaatatctgtattcttaggtagcattcactaactcctcatctacttgttttcttccattctaattgtgtttaacatttcttcatacaattggttgtcatttggtcttctttcatggagggtgcataatgttcattctcaccaattctttacactttacataactgcttgatacgaagccagaccttataaatatcaacaaagcaggaacactgtaatcagctatcagtttcagttgagctgaatgaccctgaatatgtgtacacatattttccaggagattttaaaactgacacctcagatttctaagacctggagaaatcagcatgagaaacattgatctatattattccgtgaaatgatttcactaaatagtgaagcatctcccacatgtggactctgtaatttattagaataaagagttcatgtgcttctgaagaacttgaactactcttctggcctccgtacattggtttcttagctataggaaggctgagcatgtttttcctatgcgtttcctttctagctcatcattttagtgacaaaacaatctttcgtggtgttgctctagctatagaattgtttcagattcatttgaccaaaggtggcaaatacaacagtcccaacaaaaacaaaagacctattacagaatgatggaaatgaccccagggaacaatggcacctccacatttcttaattccaaggttataagcagtggtgtggacaattctcaattccaatgctgaatcgccttctaatttcaaatacctgtgctaaaaattatttacgtctactgaaataatgaactggaccccaccaggaatggccgatatgcttgtagtcagagcacaactgtagaaagaaaataacattttaatttatagaggtatgatgatagctgtttcatactgttttcagaacgatgaatggcctgctcagtagtttcttgtcatcgtactgagacactttaatttcttaccagctgagatgaggaatacgagcccagtgtgcaggtgaaattggttaacaggagccattaaaatttggaagagtcagaatagcatcaatcaaaatgctttcagtgtaggaagtaaacatgtactagcctgacccacctgtcttttcttttaggtatgttggtaatattacaatcattttgaggtatccataaacaactgcttagatctgaagaattgtatatctttctttactctgccctggcctggggttatggttctcattgagctctaacctttcagaaaaaaaatgtagagaagtggttcaagaagaatgctttatcttgcttcataaaaatgatagtgatagttttattgaaggcttactatgtgccaggccaaagtgcgttttattatcgttcccattttccaggcaaagaagctggagcacagagaggctaagtgagttgtccaggatggctcagctaacatgctgcagttgggatttgcacccagaccaacttcttttcaaccactgtcccatcctgtgtcttctctactcaaaaagtgtttcagctccaaacctgaaactttaaagaaaaggaaatccttagtggaaagactaggttttagtcacaaattatctccttccttacattatttgtctctttttcaaatactccaagctttgattaaaactgtctatcactaggaacattgtagaattgctaaggtggaattgttaaaagaactcaattccaattaactttgccattgattactgtgtgttctggaggggtgttctttctttcaggttaatgatgctttattgtatatctcaaagattaaaaataacaatgaaggaagtagcaaaccggaacttctctcacaatgcatctttcaatctcgtgctttaaatgaagataaaatcatggctgtggtaaggttgcaggaaggatgatatagattaagtttcttgcaaactgccctctgaattttcaatagctgtagaaggtattggttttccaaaaaattgacaaattgaggattcattcagcagtttttttctaggtctcttaccagaaagtgatcactaaaaagtgtagggaaaccactcaaagttggatagatcattattttcacttaagcattttaatttcttgaaggagctttataatgcaacaaagaatttacagtcctgtgtcaccgcttaaattttctagggtcatcagtaaactcagtggaaataaattagttcatgaatataattgacccttaaattctgtcactgtgcaagtaatcggtgggtctgctggatatggctttcgagcagacaggtcaacttcttcaaacagagaagaagcatagcataaattgaagacaaataacaaactacttgtttcctccttctttggcatcaccctatggatggagtatgcatttataatttaacacaatcaagagatctttattatcctacttttgggtacaactgcttcgtttctcttttgaatctctacagctatttaaaaatctgttttgtaaaattctttaaaaaactaaaacatcagattcatatttcaggtatcttactatcttataccaacttaagcatccagtattatcacccacccttcccctgagtgaatccttagcactgggctcttcctgttttatccctgtgcatgctgagctctttctggccttcaagtctacttccgttgcaactgttgtctgaatggtctctctatgtccttcttactctctaaatatttcggaatttaaagcctggaataatctaccttagtccaaaagatatgctacactattctagttcacaatgatctcacactgccgttgatacacaacatttaatatcaacttaatatctatttcagttcattacgaggtcacttatgctacatcttatattgttgccttggacttttattatctcttcatatatgtgtttatggtgctcccaccctcacgagaagttgcaaataccatgttagctgtctgatggctttctatgttgtcaggtataccatttcccaaccagttggcattcaatgattaagttcattaacaaagaattgtatgtgttgaaaaagatgtttttttcttaatgaagcacttgtttttatttttttaatgaaatccaccctcttaataaattttaagtgcacaatacagtattgttaaatataagcaaaatgttgcatagcagatctttataatttttttaaccctacatgcctgatagtctatacccattgcacagcatctcaccatttcttccctcctccagcccttagcaaccaccattgtactttctgtttctataattttgactactttagatacctcatgtaagtggatgcgtgcagtatttgtccttttacgacttgcttattttatttagcaaaatggctacaagattcatccacattgtagcatatggtaagatttcctttttgtggcagaatgatattccattgtatgtatataacatagctttatacattcccctgtcaatagacatttagtttgttcacacctcttggctactgtaaaaatgctacaataaacatgggaatgcagatatctcttcaagatcctaaattgaattcgtttagataaatatccagatgcgggattgctagatcttatggtagttatattttttatttttttgaggaaactccatattgttttccacaaaagctgcacaattttatatttccaccagcagtctacatctccaattttcctacaccttcaccaacacatgtaatgatcttgggctttttttttttttttttttaataatggttatcctaatccgtgaggtagtatatcattgtggatttgatttgcatttccctggtagttagtgatgttgaacatcttttcatataactgttggtcattttaatgtcttctttggagaaatatctattcaattcctttgttcactttaaaaattgggttgttcgaatttttgttgttgttgttattacgttcctcatgtattttagatattgacaccttatcagatatatggtttgcaaaccttttctctcattctataggttgcttttaattctgttgattgtttcccttgctttgtagaagctttttagtttgatatatttctgcttatctagttttgtttttgttggctgtccttttagcgtcatatccaaaaaaaattattgtgaagaccaatgtcaggaaatttttcccttatgttttcttctatgagtttcatagtttcagatcttatttttaagtctttactccatttcattttgagttgatttttatgtatagtttaagttaaaggtccaattccattctttgcaatgtgtatatccagttttcccagcaccattggttgaagaggatatcctttcccagttgtgtattcttggcacccctattgaaggtgatgctaggtttatttctgggatctctattctgttccattggtctatatgtctgcctttatgacactatcgtgcgctcttgactgaggtagctttggtaattcattttgaaactagcaagtgtgatgcctccagtttattcttcttcctcaagactgttttggctatttggagtcgtttgtggtttcatatgaattttaggaaatttaccttatttctgtaaaaaatgcgattgggattatgataggaattacactgtatctgtagatggtttggatatatagacttttaaatgacacatcagatgtatttccatttatttttgtcatcttcaatttctttcaacaatatttcatagctttcagcacacacatcttttaccttcttggttgggtatttactaagttatttattctttttattgctattgtaaatgagattgttttctaaatttcctgtttttatgttgctagcgtatagaaacgcaactgttgaatgatgactttgtatcctgcaactttgctgaatttgtttattggttctaaccatgtctctgtgtggcgtcactcttaagattttctacgtatcagatcatctaatttgcaaacagatataattttacatcttcctttccaaatttgatgtattttatttctctttcttatctaattgttctggctagtacttctggtacgattttgaaaagaagtggcaaaagtgtgcattcttgtcttgtttctgatcttaagggaaaagattttcagtcttttgccattaaatgtgatattcactgtgggtttttcatatacggtttttattatgttgcggtaatttcgttctattcctagtttgttgtgtgtttttatcatgaaagtgttgaaacttgttaagcgctttttctgcagctattgagatgaccatagatttttagcctttgttctgttaatgttgtgtatcacactgattagttttcataaattgaaccatttttgcattccaagaataaatcctatatggctctcgtgtataatcctttcaatatactgttgagttcagtttgctagtattttaatgagttattttgcttctatatttatcagcggtattgttctgtacttttctcctagtgtcttttattgactttgatatcaggatactgatgccccttgtagaatgagcttggaagtgttctcttctctttaatttttctgaagaatttgagaaggattggtgttaattcttctttaactgttcattagatttcaccagtgatgacatttggtcctgggcttttctttgttggaaggttttggactactgattcaatctccttactagtttcggcctactcagattttctatttcttcaagattcaatattggtagattgcatgtttcaaggaatttgttcatttttttctaggttaacatacagttgtttacagcagtgtcttataatcatttgcattctttttggataccagttgtaatgtctcctctttcatttctgattttacttatttgaattttcctttttttttttttttttttacttaatctacctaaagatttgtcaattttattgatttgtttttaaaaaaactcttagctttgttgatttttctattgttttctatttcaattttggcttttttctgatctaatcttaatatttccttccctctgctaactttgggcttagtttgtccttctttttctaagtctttgaggaagaaaatggcaaggacatgactttctttagcagttggaaggacaatgctgtaaatactcaaaaattaattatttttatagtgacaaaaacaaaataaaaaacacttcaaagcaaatgaaagtttatcatttaatttatcaaatcactaagcagactgcttgatcagagagaagatactcatatgatcacataaaactgaaagattaagaggtaaggacattcatgttatcattacatctaactttcttatttccaagatggagaaactgagggttggagaaaaagaaagatttctttgttagatacaaacagacaggactaaactcagtatagcagcctcctaaattccaaagtatcatgatactgtgattttatgcattcttcagaaaaatagtagagccactggattctggcaaagaagttatataaaatgtcaagttcttcctttgcctcagaaatgaagttttatgttccaaaattgattgggaagttctccttatacctcacatcacgtctactattttacattgtttacttttgaagaatttttttaattgacaaataataattgtacatattcatggagaacctagtgatgtttttatatatgtaatgtatagtgatcagatcagggtaattagcatatccattatctcaaacattggtcatttatttgtgttgggaacattcaacgttctccttctagccatttgaaacttctatattattgctaactatagtcaccattcagtcgtatagagcactagaacttatttctcctatctagctataatttatttttaaatatgctttttgaatctgttactataaattgaatgtcacatcgttttgaaaatattcttaatttatgctcaacaggcaagattacacacctgtgataatatctttaatttaaaacattactctgtttaatttaccagaatatggaaccctagtcattttagaggtggagcaaatttcagtgataatctagtgcaaatttctcatcttatgaatgaggagattgagtctgatataagggacgagattttcgtcaatgagcagcttgttaacattagctctgtgatagaacacaggcacttgtcctcccaggccggtgtttcttctactctatgatgggctgttttgttgtagtttttaaacagcagcattttcaccatgcatagttttcttccaaagttcgttcttaacgtttttgcacagaataactagattttggaagtagaaaaaggaaattctctttgcatccttgtatctctggttattttctttgtcctttgatctctctctcctcccctcccctcccctcccctccccttcccttccctcccctctccttcccttcccttcccttccctcccctctctcacacattagagaaagagttaaggtattaaagaatacataatactattaaatttccttcacatagagaaaggaatgaaaaaaagtgaaaaatggtcctcaccaaatgtccaaacttctgtaggtcatttccatagtatcagcaatgtcctgtatggtgcctcggggatatgtaagcaaatgagcaagtggttagctaattctagctttggcaaacacttgttatggcttacttgaggagaagtcacttctccaaagtgaaaataatgtgcacaggtcaattagaatttttttgtagaaaaggaaaatactttgtagggacatggatgaatctggaaaccatcgttctcagcaaactattgcaaggacaaaaaaccaaacaccgcatgttctcactcataggtgggaattgaacaatgagaacacatggacacaggaaggggaacatcacacaccggggcctgttgtggggtggggggagggtggagggatagcattaggagatatacttaatgctaaatgaccagttaatgggtgcaggacaccaacatggcacatgtatacatatgtaacaaacctgcacgttgtgcacatgtaccctaaaacttaaagtataataaaaaaaaaaaagaagaaaatacctccttatgctcctgacttattttctttttggttcctcagtcctcttctctctctctctctctctctctctctctctctctctctctctctctcacacacacacacacacataccccacatatacaatatgattaaggatatatgtgaataatgaaagcttcttgtgtatagatttagaagtctaatggacaaaatcaatattttcctatgtgcatttaattcccccctttgatttaggtatatagtctttttttaaaaaagagaaaaaaaattaggtgaccttaaggtatagatcctactttcaaaaggtttacagaactagggagaggaacatggacaagatttaaagaactattttaagcagaataaaatgtgatttatgaacaaagcatatattatttgtgcgtatgtgtgtgtgccaacaaagatgcaattaggagattgcacagggagatgtcattagaaccaaccttaacgggtgagaagtctttgaagacatttagaacatggaagatctctgacagagggaacaaaggcatagtgacaaaagtcaagggcatatttaggactggagagtggtatgtgtggcttgagagtgggcgagaaaaaacaacaatgcctctgtaataggaaagtagacagaggcatgacattaagagctttgccagctgtgctaaaagtagtgaacaagagctaacaaagtgaagaaatgtaccttttctgatgtgtatcattcccttattcatatacttcttgagggggaaattcattctgtgttgatctagtaaactactacaggaccaaatgataaaaagaagtataggaaagaatgtttcagcatactttacgagataacttccttgtagctattctccatagtattttgagcatcacaaagcaatgagctgaaactgtctaagccaaaattgacttgtcatctgttagggatgcttagatgagaattctacatttgagagcttcttagattcattgaccactatgtcccattctaagatccatgaatgcgtgacctaactattacaccttcttttagtctgattgtcaattttgtattttcaattgtgcaagtttctaaaactattttaggaagataaatctagcagtggtgtgggaatagacaagagagaaggggaaagactcttcaggaaactaaactcacaatttatgagtattctttattgcccaagtcttcccaaagtctttcatcaagaaagaggcattgcaactctccttttatagtttgtttttattctggagcagtgatgttttggtggagttgttcctcagtgcgtaattaaagggcctatgacaattacagttcatctcctgctgctcaaggtactgcagatatttggatctactactctcattcatttccaattaatgtcagctttagatttccttcagtatgctatgttataaaatttgattatcgttgtgcccaccttcccacttaatttcaagcaggtttctcgattacctgactaaactaatgaaatctgactaacccaatatctgtggacagtagtgtgatgttactgatttttgtatgattagtcaagtcatattcatgccacgttttcatatagtaccataaaggatattcttctcgtggtccttttcttttattctgaacatacaatgagaagaccggtaaagtgggctaggaaattaaagaaaaatacaaatggcaaaaaatatgggtcactcgaagtctagaatagagagcacaatcaattttgaattaaggggtgataaggtgatttggtcaggtgactggtgaaacaggaaagaaactatactttttgaagtgtttcatccatgtgttaagattcatttggggtcaagaatctaaatttcatatccctgggagtggaaactaagtaaaaaaaaaaattatggaccttggtttaatagctagaggagcaagagtgtatctttatgtgacttaacttctatgtgaaaagtgaaccttaagattaattattgggggaatttacttactcaggttctatgcctagatggtctgcccaactaagaaaacttattttcctgttactccatcctatttttcatacttttatactgcacttgcagaaaagcatatatttctacccaatacgaaaattcctgggaacatatttttctacatttcccaaattacttcaaaaagtaaacttaggttatttcatgatctccattacaatggacaggtggccttattgaatgttgtcctgtgaatacaaagatccagagtttaaagaacaaggtgtacttgcatctcccacttagggtttgcttgtggtggagagagaatctagtttgcttaaaaggatgacagtgcagtgccccaaaatatctgatatcattaaaagtctcatatttgtctttcgtaacttctctagggctgtcgatgacaggagacccttaactcctatgccttgattatgtgaataagcacatgaaaatattttagttatcttagttcacttttaaactaagtttcaattatcactagattctaaatatcatcattgagccgttcttaaggaactgattttctacatattcattcacttcacctatatctagtgtgtctactatttgccaagaaaaatttactctcttaattcagcattccatatacttaacatcataaaaagtaggccatttttagttttctaaattatttatttaaacatttctttaaaattacattctatcattacactatatttcaacactacagtaagcagcctattttgtgatttttccttatataaaatacataattgaaattaaaaatgaagttaccaagagccattttcactctggggaatgcacatttataaattatggggttattttttcttcatcagctttcatattattaaactttgtctcttcataattacagagatgactagacacagaagggaatttaacatttggtgtgcatttgtctaacctatactttatgttagaaaatacatttccatttgaaaaaaaatcagtaattgtgggtgtgatcaagagggcagcctgaaagtcgggtgatgtgactcacacctgtaatcccagcatttttggaggccaaggtgggattatcgattgagcccaggagttcaaaaccagcctgggcaacacagtgagagcctgtctctattagggggaaaaaaaaaaaaagaggaagttagcctgaggcaatgtaaatgaaatacatatttcaaggatatttatacatgattcacgttattcatataaagatgtgccagagaagactataggtacgttattttacactattttgctaggattttaagaaattcaatgtgtttttatttcagttaacttagaaaacttacctaacttatacttctcatggacacaaaagtttttaaagataggatcaaaaagcccacatggtgaagcattttgaactggatgaaaaacatctattatctttaaaattttatgatattactgattgtaatagactccctttttaagaaatcattccttatagaacataaggtttacatttacaatcaacaatttctatccttactacaataaaggcacatataaaaagtacagttgcatatttagcaggtttaattgtacattttaatgtagaaatcaattcaattctttcatttatcagcattattacagtgatttcaaattaagcataggtaactttgatatagataaatgatgtacacagcagttaaattttattttcaattatgtagtaattgtataacctaggcagtataatttgtaaactttgtattttattattatgcttctcccacttggcataagcacaacacttcctaaaagcataattttctatagacttaataactccctaaaaacctgttttggacccctatactatttgatataggcagaaaaaaaacataatccatgctcaaatttgaaaaatgactggtcacatttggtataatactaaaggtaaataaaatcaagagtctatgaacatttccggacctgcacatttgttttattaaaatgcataattgtctttagtgtgtttctatttgtttatactctactgattttaattaaaaataccaaaatacgtttattaaaaaactgtcagaatctaagttgttaaatatacttaactaggaaagtaactgtttaaacgagataatttatagagaaatgtggtgtattgccaattagatgtcaagatacaatacaactgataatgaaaaagtagcattttcttagggatggaatacagtgtaaggaacaccccagtaagaatacaaaaattactgaaaaaaaatcttccttcctgaaaaaccaagtgcccttcaagtgcagaacctcatccaactaattgttaggtatcactaaagcctgataccttcaattttctggatcattcaagctgtatttttgagtccttatactagaggaggtaaagagctataaaaacacttaatggtatctgatgtgaactgtggatcactttgacccatcacttctacgtctacatcttggataaattcccattgttgtcatagattgtacaggtttaatggtgcgtttgtggagggggctcgcttatagaaaatggagactctgaagggataaggaataaatgtatcacttcaggtcttttatttgaaattggggtccagagagcctttttgtatcagacttgtcaaaccatttccatttagtaattatatatgcactagcacttattcctacttacctcacctctttatgcccatttccttgtagttgcggttatgcatgaataatttattgcaccccttaccaacaatggaataaaacttccattctgaaagctttccatactcatttccaatagcaatagggtttttttaacggacgtattacaaatgtacgagtcagttgaacatagtattcctctttgtaagaactccaagtggatgcatgctgttgtctcaaatctcaattagaccttgctttgaggtcccttcattgccagtcatctgttctccttcccctgacttgagtatttctccagatatagataatacattttcccaactctgtgttccaagaactgacagtggctttcattcattttgtttgtttgtttgtttcttctcgttctcaagtatcccgcagtctactgtttcttccctccattcgtttgtcctttcagagtttcaaaatccagcataggtacttcttctaaaatgtcttacccttcacatacacacaccacttgagaccccatcagcctctgtccacacagtttggttacattcatagactatttttatacatcaaaatatttgaaaattttagggtaaatctcagtagtcattcatttttgctcttattcaaccaatactagtcaatcagcctgtgccaggttttgttgcaggtaccaggtatccatccataaagaaaacaacgtccctttgttgtggaatttacattttagcaggggaggcaaagaacccaataaatatgataaaatatcagattaaaagtacgatgaaaaaaatcatcagggtaaaggaaaaagggaagcagtattttagcaagagtggtgaagagaggaggctgagagtgtgacatctgagcagagacctaaatcaagtcaaggaatgaaacatgctactatctaaagaaatgagtcaggataaggaactagtaagagccgaggcccagagatgtgaatatgctgttccaggaacagcaaagagactggttgatatgatgtgaaaaatgagaagaaaccttatgatatgtgtcaagagaaaaaaaaaatttaaaagcatgcttgggaacggaggcctccagatgaaaaaaaaaaacacagttcaaatccttgttcatgcatttagtttgctttgcaatcttgggcaaaatgttaaatttctgtacgttttatcttcctcatttttaaaataggcacaaggacatctacttaataggttcattgtgaggagtaaatgagatgatatatctaggatgcctggcattatatcatacacttaataatacactgaataaataatagttatgtctatttatttccttatcgtttttattattatttcaatgcacagacctgttcataagataatgataaatattagtggcagaaactgaagatgttataaattattaggaggcgggaccactcagttcaatgtatctgttttaatatagtcagcaaaagtgtgaagataccaacaattaaatttcaatgcattcttccatttcactagttttataaactgatgaactaccagaatgtcaatgtatgaattgcatactcattcttaacaaacagatttgcaaaattatgtgtaaaattagccctcagccttccaatttgttattgtcatatttcatggaaatacataatctgtaaatttttgttttaatgatatgtgaaactgcctaaagtagagtcttggcaactacttcacatttgtcctccagagatagtggataaaagtgtcaataaatgaacactctatattcactaatcacaggcaagggacaaggaacagagtggtcacaaaataccacaaaattaaagcacattccaaattaaatatatatgtttttattacagataatgtttgctagactctttctaattatctgcaaagattttaggaatgttttaatgttttaatatttacacacctgtgtatttcaagttcagtcaaacactattgttaaaactaaatcttctcatctctaataataagatgtgaacttatcttggaaggtggttattaggatgggagagataatgtatttcattcaaagtaaaaatatttctctgtttctatctttctctttctctgtcatctatttatcatctatatccaggtatctatgcacctatgtagactagcattcaatgaaccatagatattattagtagtagaattgttactaatattaaaataagaagtatttaagaagaaacatgtcctaaagcataaggtcaattattactctcatgttttttggcatatgaagcctaaaaagtgtcaatttcaagagagtattaataaagattgtgataactgaaaggttcctgcttgaaattttgtgtggtcttacaaatatataaactctaagcatttcagtgagccaattactgactaggcactatgtcttatgactcttttgtcatagtatgtaaaaaacaaagagtagagacatcataaaaattatagtagatgggcactagggaattacgcaaaataatttgtagatttaatgtgaaaccaaaacatctgttcaagtcaatttcccacaggtcatgtggcaaagagtatgagttccagactgaggagaggaaaaggttgttcttccacagggaaataaactgagtgtaataaacataatttttcttcttaagcattatttaaaacaaaaaaaatgccattaaatctatctttcctgcctctcttatcaatgctcccttccctttcaccacttgtttcaaactccaagccttgggattttattttggctttttgccttaatgtaactaaaatgagagcatcacaaatatgaagctcatcaaataatttagcagcattttcccctgtttttaactttctctttggaaacgtagatttcgaaatttaagggcccaaaatatgaaatgcaattataataggccatttgttcattcagcttgataaacttgaataaatagtattgaacttttaatgcaaaaagaacaaaacaaaatagaactctccacgaagaaacttttcaatgtttgcatttctgtgtgaggagaagggtaatgaatgtgggaaccttaatggaatccatgttcttccagtgatgacaagggtcaaaatggagaaaaatggtcactttctacccagtacattatattagttctatgtggacaactataacatagctgatgctggttttcaggccataaatgtaggtatgtattttcctactatttataaggcaaaatttctatttgtttaatgatttctatataggtagattattctgtctttaggattaaaaacgacctgtagaccaagagactttctaatgtccaccttagagtatatggcttttactgttacagtttccatttcctttgcttgcccctttgagagaaggaaaggagacatttgggatacatacatcaatgaggagctattaatgaataaatgaatgaaattgtcagtcaatttatccacatgatcatcaattgccaataattttatcacctctgtgggattaagtagaggtaacagtttagaaatttgattttttgaaagcatttaaaatgttcaaatatatcactctggtaactaagggaaagtgtattattttcttatgcttagtcttattttggttttgcctttttaatttaaattgaacacttatatcaaagagcttgcaggattataatttgaatttttgaagcaaagatcattttcttaacatcaaacaaagagtagatacaataggaataaaatcggcagaaaaacaagagtatcaaggacagacggggagggtgggtctgtgttagcatgtattgctatgaagaaatagccgagactgggtaatgtatttttaaaaagagctttaatcgattcatgattctgcaggttgtacaggaagcaggacaccagcatctactcagcttctggggaggcctccgggagcttttactcatagtggaagatgaaacaggagtaagcatgtcacatggccagagcagaagccagggggaggttgccacacatttaaaaaaaaaaaaaacaaaacagatcgctcaagaactcagctgctatcatgaggacagcatcaagctgtgagggatccacctccgtgactcaaacatctcacaccaggccccaagtccaacacttggcattatatttcaacaagaaaaaaagtttaattggctgatggttctgcaggctgtacaggaagtgtggcacaggcatttgcttggctcctggggaggcctcagggagtttttgctcatggcagaaggtgatgcccacacactttaaaaaaaaaccagatctcatgaaaactcactcactacactgaggacaatacaaaaccatgagggatctgtccccatgacccaaaaacctcccgccaggccccaccaccaacattgggaattatatttccacttgagatttgagtggcggcaaatatccaaactatatcagggctcatgtccagttatatgtcaacatgcctgcattcgaaacatcctgtccaaatcactgccttgtcataatacttatatttttctttattgaatacgaacacaagaagattaaataatagcatttctactttaaaacagtgggcaccatattaacattggaataatagtagtaataacgatagtaataacaatgatataggctgggtgcggaggctcacgcctgtaatcccagcactttgggaggccaaggcgggcggatcatgatgtcaggagatcgagaccatcctggctaacacagtgaaaccccgtctctactaaaaatacaaaaaaattagctgggcatggtggcaggcacctgtagtctcagctacttgggaggctgaggcaggagaatggcgtgaacctgggatgcagagcttgcagtgagccgagatcgtgccactgcactccaacctgggcgacagagcgagacttcatctcaaaaaaaaaattaaataaataaataaataaataataacgataaaaggatatgtgtaggttttttttttaataggctgttaacattaataggcattgtgatttcagggatatcatcaaacatcctggtcctaagacatcccctattgaataggaagggcttaagttaaacttctcatgagccacaattttctgattatatgtttggtgtgtgtaatagccacctcagtgatgatttgattagcctggacccttacataatcattgaagtatacccatgttcctttatatacttctttagtgttgaaagctcaaaattaagcaaaatagtccccttgataatgtttagattcttaacatttgctttctaaagctggcaaatactctcttcccagtgtcatgaagttaaataacatgttgcttagtgaggactttaatgttgccatgccataggaagaccttattcgaaatccccttacctgggagaatgtcagattattaccccccaacttgtttaacacttttaggattttaaaggtgttcacatttgtattagaacaaaatactattgagaaacatttctagaaaaaaattatctttccaaattaaaatcagtggtatgtaatgtaggagtctgattataatgattaaaatacatgggctttgggcatactgcctaggtgaaactcctggtttattgcatcactattagtataacctatgggagttaacctacgtaagcctcagttaatttttctctcaaattgatctaataatcgtctctcataggcttgttttgatagatatttcagtgtatataatatacttaggacagtgcctgatatcagtaagtctccttatatgctatttttctttctattttaattatttatgcaagagaaactattatgctttaactcaattaaaataaaatgcctttgtatttattcatgtcaaaggaaatatgcaagtattgcattcacttcctaggtgcctttttgaattgagctttgcatggttagtttgtataaaaggttcagtgaactttctcataatgattttttattgaacatatggaatccattaagtgttagcaaaagtcactatccactgagctgtgtccaggggctgacagttatgtctatctcttgcaaaaataaacacatacataaatgcactaagacgtatattacctgtcgtcatctcttagagcatttccatttttcttttaagttttttctttcaatgggttttttatctttgtgagtacatggtaggtgtatatgtcaacggggtacatgaggaaggtgtatatattgatggggtacaagagaggttttaacacaagcattcaatatgaaatagtcacatcatggagaatgggttatctatcccttcaagcatttgtgctttgtattacaaacattctaattatactctgttagttattttaaaatgtaccattaagttattactgactatagcaaccctattgtgctatgaaacagtagatcttattcttatttttctaacatcttagaacatttccacaaacactacctgcttgttaaatatacctattctaatcttcatataatcaattacttttttcctctagaatgtactatgacacatccatggggaaaatgtagtaatctaattaagactatttcctctcattttatatttaaaagaatgtgctctatcaatttatttacttgtacagccgtaggcaacctctaaaatatttaaagttcttaaaagtcagatatttcagttaatattgtgattatatagttgattttgatgaacatgttcatctaccagaaataaattatacacacacattgatatggttaggctttctgtccccactcaaatctcattttgaattataatccccgtgtgtcaagggagagaccaggtggaggcaattggatcttgagggtggttttgcccatgctgttctcctgatagtgaatcatgagatcagatggttttataaagggctcttcccccttccctcctcactcattctccttcttgccaccttgtaaaggaggtgccttgctttctactatgccctttctactatgcccttcaccttctactatgattgtaagtttcctgaggtctccccagccatgctgaactatgagtcaattaaatccctttcctttataaattacccagtctcaggcagttctttattgcacatatatgtgtgtgtatgtgtatgtgtgtgtgtgtgtatatgtatgtatatatgtatacatatgtgtgtatatgtatgtatatatgtatgtatatatgtatacatatgtgtgtatatgtatgtatatatgtatacatatgtgtgtgtgtatatatgtgtacatatatatatatatatatatatatatatatatatatatatgaacagagagagagagagagagggaggaagggagagagggagggaagcatggagaaagagagagtaatagcctaaatagaaataaaactagctccaagtacaggttcgtcaacactctcctatcatacccccaccaaagttaatgttaaccacttggagccctgttcttccttagttgtggagtactttagcaaaattttaaatctaattatgcctaattcaacgacagtgctaatttgaaagtgttagaaactgaagacctataataataatgagagttacaaaacataaatagtgagacaatgatgaatgtagtggatgcatgtacgagggctatcatttgacagtagagatgatgctcaaggacagacaatgagtctttcaatgtgtggagaatgtgctgctgttacagtgatgtacaggaaagaaacaaaaactgaggaagtatcagtaaacaaaacactcaaacatatgagtatacagctagaataaaagcaacagtactagatgacaataagcccaatgttaactcagaaagcagaaggtttttaagaatttggggaatactgtggctgatgatacttatgtctcaagccacagatgccatatgggctctgcgcccagttgaatcggcaccacctggcagtaagtgggcaggtccacgactgccaggacatcccttccaacacttgtggagatcaccaggaaggggggagagacctgccttgacagattttcaatgtgggcgaaacaggtctattttgagaaaagatgttcaatagaacatatgtcagcaaggaagaagagatgatgcttagttctaaagctccaaagagctggcttacactccaacttggggaaaatgcatccgggaaatgcaagattaatctcatcttagccattcttttgaatggatggacatgacccctttctacttgaagacagaaaacataaccatattgatttcaggttttcttcattggtttccatttaggattgttcctccccatcttctttctgtgtaggcatcccagttcccaagtgttcatgaagcacgtatggccttcaggggatgtgtctgtatacattgttatcttatggatgcacggttttgtctgcaccttggttctgaatgtctttactcttgagcatctgcccatgggtccccttctcaaggcctcaatttcttgagtttaacactgcatggcccatgcagcttttcagttaagcatctcttgctatgaccaactcttttcctcagtcaactcccacactcttttcagggacaggaaaaatgtagccacttgctggctgcactctgaggcctcaagaaatttagtgaatctgcctttgcccttcttgctgatgaaatactgccacatcaggccccctcttcggaaacctacaagcatctaattttcttgcttcctccccaactttctttttgactcccccccatccagagagttcttatgtctactgtactaggaaaaactcattcttaaggtatggttttcaaatcattctctggtctggactttagctacggttttaaatgaagaaacaacccagagccaaaatataatgaaactatttccttcttccacagagtggaaactgctttggggttaaagggccagtgaaccaaatagaaaaggatctcagggaacacagattgaagagagagaagaaaaaatatgaaggcattgttggttctcttttgagtttaaaatctagtggggattgtaagcacacacacatatacacacacacgcttacacacacacaccagtgaagttatgaaggattttgtcactccaacgaccttgaatttgattatctaggtcagttgttaccaaagtggaatgtacatgcccaataatatgcgtgctaaacagttggggtagtgagaaaaaatactttttatttatcttgttctctagaaattaatattttgattgtatattttatagtgtatgtgatgtgtaagttgtgtctacaaaactagtgtcaatgtaatttaaaattacatatgtctgtgaatatatatttatatagggtacatgcttaaaatgtgtttacttctgaggtacatgaacatttttcccccaggcacagaaagacaaataccacatgatgtcacttaaatgtgcaatgtaagaaaagttgaattcatagagatgtagagtagaatcatggttaacagaggcttgggaggtggagtgagggaatagagagttactgttcaaagattacaaagtttcaactagacagagggaatacattttgagatctatttcaggaacattttgagaccctcactctaagtaataggaaatcattactttagttaacatatttgaatatgagttgtgatgttctatatcgtttatttggattctactaacccacacctagatttttatggcattacctttttactcactgtgaatatcctactcatagacagatgccctgggaacttggacttgaggcacccaagaactgagacagtgagatttgggggcacaaggatctatggataagttcatcttagtgatgataaaatcaatttggcatgtttcacggacagtgtgcattttagaaagggtaaagacttggaaacgggatatttttgagcccaagtgtttccaataaatagctgtataatttgaagcaaataattgattttttgttctctttgtgccctcgcctgtaaaatgggagaaatgtattcctttctcatccttctcatgaggccattgagagtatctaatgagatcagactgtgacatagcataataattctcatttcttgaaggcctattatacactttgcaagcactgtatgtgttgtttctacttctcttgttcgtttttcctggaataaatatccccccctcctttacattggattgccattattcaccctgtaaggaaggcttcatggttctcattttcatctgagaaaacttaggctcagagaagatcagtaacttatctaaaacacacacatacacacacagacatatctatgcccattattcttaacctagtttctctattcaggagttatctctgctgtctctgcttctgattataatctgtgtaagctgatccaagtgacacgattacagggaaattgtaagccctttgagagcagagactacctattgatatctacattttaaaatttgattttagccaacctgtttatatgcaatgactaacaggttagtttgacttgcaataaatattccaaatcctagactaagtaaatttattaatgtaatgatttaacttgattttttcattggcatgtttccctgaagtcgtcatgcaaaattgaaaaaaaaaaaagtatagtgtgtgattctagattgaaattcaggaatcctccagggttaccttgtttgctttccaaatagttcagattgcttagtctgaccaacaaggtccctgacacttggaactctgtctatccctctaattgactttgtccctgatgacctcgcccagagatactcttcaccccagctatactgtgttgctagagtttctctgatatcccatgctattgtttcctttgttctcttcataaggtaccatttcccacccgccaactcctgttttcctgatggacttttgtttcaccttacaagatcattgctaatgtatttattttgagaataaaaagtgtaggaaaggtcacgggacaaagctgtacaccagacctttcccagacgaacctagtgtataatctccctagtccaacatcatggcttaaggcagtcgatagatccgtcttaatgtcccttttgagttttctactattattatatgaggatttatttttgtctgaattcctccctagatttgccctagagagcaatgactatttacagtttattcctctttgtatctcttatgttaaggccagaccttggcacatattctagctgattagaagacgtttgttgaatgaccaagtgattgaacaaatgaccatgtgctctgccacagtccggtcagttctactttggtttggttatgtgtttgccacattaaagttgtagcctgggaagttcagttgtgagatgtctgcagaacatgaaaaattggaataatgaggttatttctaaaattgctataatttaaaataaatagtggtttattccatatatgaatatacactggaaacaaagaatttctagaatactggagattcaatgataacatcattgaaattaaataaataataggattatgctagttactttctaatttactagaaattgaccgtgtgcatggcacgtataatgagtatcatgggatagttacaaaaagtggtgcttagtgagtttctgtggaaaatctcggtaccaataaaacggaggatttccagaaatcgatattcctcaaagcttgacagtatttatgcacggttacactttgtgtgtctttcgtttgaatcaatggaaggaggctataactgaaaattattgttttagtgtattatatctttaataataagagttttaagaatctatcattagaaataattattcctcaatttgtaattctcaacatttgaacaaataaatgctctgtgtctatcagttaatcttgcccatgaagatttaataaagcacgctagtttttacaaatgtgattttagagatggtcattacttggtaaaatattttgtgttaacacttccatgaatatgttctgtgggaatatactgcctccacattgcttgctcatgaagacatgatttttcacatcatcctatcagtattttgagaaagagattgatcccatattctatgagcatttgaacattctctagtatttttgtttaatcattaaaacaacccttgaagtctatgtgctacactggttatttccctcttgactttcctttacagataaccctctatcataaacaacctatctatatttgttgtctccacatcatgttgccagccctgctttaacacactgcacattgacttctagcagcaaaggctcatgggaggtactctcatcaaggacactgatggtcctcatgttgctaaatttggtgggtcctctacagtctttatcctagttcaccttattatggaccactgtcaactctgttctgcttaaaacactctgttccttgcttatatgactctacactcttaactcctttgtgaattcctcatctgcccttccattaagtattgacgacatccttcatagttttgatctaggacctcttttcctcttacttgacattatgtgggtaatcttgtctttgaacgcaattaccattcttatgttgatgacccttaagctataattccagcccaaatcatttttctgaggaagctacaagaatacacaaatgtctaatagatctctatttagatgtccctcaggtgcttcaagcttaaaatactcacctgagctcatcacctcatctataaattctgcttctcctccctggctccctgatttatttaatatgaccaccatccacttagttgaataaagcagaagcctggacaccatctatacctccaattaatcactaagttttgttgttaaatacgttcttacattttctctctagaatgtcttattttccccatctttacacccaaaaccaaaagtcagatgaccctgatctcctgcttagatttcaaaacactatctcttgcctagactctggaatttcagtcttgctcctctccaatctatttctacaccctagactctggaatttcagtcttgctcctctccaatctatttctacacaaaagctagagtaattttttaaaaaacaaaaatctgaatgtgttcattttctgcctaaaagccttcagtaattcttatttgttcttccagggatagagtaacaactttcagacctagtttattagctagttctttaaccacaaaggactctctcacttgtctactccccctaacacacttcgccctaacctttgccattcctccctttcccttttccttcccagatggacttaagtcctttcagattcttaaatgtttcttcctccagtctcttacatctcttttccttgtaactctaaaaactacttagcttacgcaaggaaaaaggtctgtacaattcccggaatcagcgatcctaacgttccctgttgtttttttcgttgggacatgaattcattcacagtggctctaaacatcaccacccctgcctatctctcccattcctactttatctgagcttatccatactcttgaagacttacatattttttttctaccaggaaatcattactagccttattatcccactgtccaaaccaataagtctgattaggtatctgtatatatttaatattactatatgtgtttttctaacactctagtagaggagaaggtgtatttctttctgttttttagaagcctgtatttctgctattatagctcttaaggaactctcatgcaattgcctactagaatgtaagttacggtaggataagaactggatcagtcatatcacacatccacatataggacctagcaccatatctaacacacagcaggtactcaatacatttctttcccaaataactaaagagtttaaacaaaccaaaatgattaaatgagaagtaactgttttggtaattcttgtgtccttactagagtctaaattgagtgatttttatatcatcagtttatactcccctttcccaaccccaattctttcttttttaaattttttaaatcaaatatgccttaaaacttcaggatcagttgagtaaaatgatgcttttgtcgtcttttgcaaaataattgtatttcagaattttgatttagatattataaacacacctaaaataatagctttagtcttaagatgaagtgcttcttaaactccctaagatgggttggactatggatatgaacatggacaatatcacattaatttgtgtacacagttctaacacagggtctggcatataagaacaagtcagtaaatagttgttgaatggaattgaaaatttaagtagcaaataaagtattttgacctacaaagcaagaaatcacatttttctttttgtcacagttccttaggaagataattaattttttagtatttaaggatgttaaatatttattttatgttctatttactaggcttctttttatgaaaattaattggtgaaaatagcgtacatatcttcctttaccagaacatttacattttgggcagtaacgctggcttttgttaaaaaagcaaaatatgtgtgaaatttatgtttgagttgatttcaatgcattacatttccattttaaatcttctttgaaatactctatttttgacaccatgaaactgtattagatcttagtatgttagcaatgttttgcagttttagagccataattattttaatgaccactttcagcatatacgttttctacaggaaaaataatctcaagaacatgaaaagtgaaatctatattttgggtttcaaaatgatacattttagctaaaatatcatagttttaatttctcagtgaaaaatatagtgtggtaatttatgaagagactcagtgtttaaaaattatgactctatagtcaagtttatgtttataggacataggttattcaattacatttaaaataattaatttagaaaatgtgatcaatgtaacaaattttacctgttcttttctaaagctaaatttgttgtttgaagtgtttcttctaaaatgctaatgaactatcaatttaattgttgagcttagagttagaaacttaattatattgccagaaataaagaaacaaatggatcccaaaagattcacacattagaaatgtatgccagggaaatgcttttgaatgtgttcaagtcatggcttctaactcgtaacttataacttgtgttatgtctggcttcattcccttaagaaaaaggaataataatgccttcggagagcatcccagctgtaagagctatgcattggtgtctaaaaaagcttctcactcctcataccatcctggtctgggaatttaaaaaattgtcatcttttgataatctgtatcacatagtcttctgcatagtcatatgaggttagaactgccccataacttttgcagggcctatagtaagtgtgcaaatggttgcctgcatgccacatatttaatatttataaggtataaagtcaacagactattaaatatatcctatctgctttccttgacaattatacaatcataatgatatggacatctagattcgatttagaattctctctctctcattttctttttcttctttctttctttctctttctttctttccttcctttctttctttctttcttctttctttctttctttctttctttctttctttctttctttctttctttctgtctgtctgtctgtcttgtttttttaaatagtgcaagcagtttattccctggcaaggaatttggaaaaaactcaaatagcaaaccacttgatacaataaaataaattccttagagttttgtactggaatgaggcagcttggttagagctaaccctaagcctgttatttaggatacattggcttttcttaagcttaaaaaaaattttactgtgttaatgacatttaacatgagatctatcatcttaataaatactacatgcacaatacattattattgactctaggtagaatgttggacagcagatctctagagctaattcatcctacttaactgaaatgtaatgtctgttgattagtaacttcctatttcgccctatccccagcccctggcaaccaccagtccagtctttgattttatgagtttgactgttttagataccttatttcaagtaagtggaatcatgcagtatttgtctgtgtctgtcttgtttcacttagcgtaatcttaaggtccatccatattgtttcatattgcagaatttccttttataaaggctgaatagtattccattgtgtatatataccacatttatctattcatctgccaatgggcatttaggttgtttctgcatcttagctattgtgaatctgttgccttttttccctacctcctttactccatcctgcactgtgaggaactctgtgcacatagatctggtcgccccatttcccacccacatgttcaagtttttcccactcacctcatgcaaagatttaccccttagccatacccagtaactgactttgaaacatttgcccagggagttgagggattctgaatgccagatcatgggagcggggcttctagtgagcatgttggcttggtcctacagactcctaatcagagctttgcctttgaaagcatggggcccaagggcaaggaccctacttgttaaggtctaaattttttttctgaaataaccacatcgagcttttatgtgtagatggcctaaattgggctaacccagaggcagtgacactcaagtagtttacatctaagcgctttccatgtgcttcttttcccatttctgttacttcttacaaaataaaaaatcagcatctcaattaccctgatttgatcattgagcaatctaaaaagtatcaaaatatcacatgtagcccccatatacatacaactgttatatatcactataaataaatatatacacattatatttaaaaatcaatactttaattttacatgtttaacaaatcactagcatatacattccagattgaacttacgagggatgtggaaaagattcagtgactaaataacaataaagtactctaaaaatgaaaatgtgaaatggagacagtataaatctaaaatcatatcacttatgaagtattgtttcaaataaacaataaaatatatcttcaatcaatttaattttattttagttgtataaaatctttcggtcagcattaacctaattggaacactaaataggtacatctaaaaaatataatcccccccaaaaatatgtagctcataagagataatgcattgaacacagataatattggcgttaaaaacagaactctaccacatttgcaacgaaatgtttatctgttcttcctactagaaaataataaaatagttctgcatgagcttgaactcgaagtattaggtgtacaaagaccttttagtgaatgaatgctagctgaaaagcaaattttaaatatgaaaaattagcaagacaaacatttgaatttgtgggagatgagtaaaactcctataaaaatgaattgtttagtgttaaacagattgtgtatgaaatattaatggcatattgtcctgagctccccttccgctgtttccatgtagatgactgaatttcaaacagaaatatgccaggaatgattacgtgaatgaatattactacatgagattgcttaaagagtatttcttcttttgccttctttttactttcgttatttcatttagtagttagaaaatactgtctacaaatatgtgagaactgcttaatttatttttgagacattaattaattcaactaaactatattgactgtgtgagagagattcccttggtgaatatgtggatttttgcggtggtaagaactctcctctggagcgcaaatggtattgctctaggaataaagcatatacctcaggcccagatgaaccagtgcaatctacagtaacaggttcaaagatgacctcatgacctactgtggactaataaaaatcaaggagacctactgcaaaggtttctgggaaattctttttctcttgcgttgaactaagtaatatacatatgtgatagttagagctgcagcctttgtaataccatgacagaagataacctgaaataaggctgacagacacaagagggagacctaagagtactgagagatatggagcaggaccccctgattgaacttcacttgcagcccccttctgcagttttcaatgacgtgaaccagtagaatccctttgtttactgtttttgattaatttgagtgcagctttatgttatgagcaactaatagcatcctcactgtcacaactgccctctatacggcaggcactttgtgatactaaagaaagcagtatacagagtagagcccagtgaataacagggcagatgttgcaattaaactgcctgtttaaattctagctcttccactagctaacttgtgactatctaagtaatttaaccttcctataatcatacctatcttgaagacttgttgtaagatttaaagcacaacagtgctactataaaacaggtatacagtaaagcttagctacttttttattaggccatatgatatcatttcattaaaatcttatagccatgctataaggtattatgatcctcaatttataaataagacagctcaagttttggtcaagtgactttaccaaggtcatagagctagaaaataatgattccaagttacaagccaaacctcttcaatgccaaatttacatcatcccccattacttgaagtgtaagattcacatggacagaaatttttgactgtttgatcactgctatctccttatcatctaaaacagtctctggtccatattaggtgttcaataaatatttgtagagtacataatttccttcacagactccacaatctggtgaaggaggcagacatgtaagagaattatttcaggattccacagttgatgctgtaacagagctaaatataatgaatggaggaggaatgaataagtttgtctgggagcaatgctatggctattgaaataagtcttgctcatgctttgattgaaatggtggatatagatcacacaacaaataacaattagataacagcttgttgggagaaagcgaggatcagtgtttgccataaacatttctcatagctaatgtcaggtgtttgatttctcaacattttatatctttgactttgattttctctgtttttattttttaactccattctcaagaagtctgcacataagagtttcaacatctagcacttcataactccgtcatctcctctcaggcttagagcaaattctgagacgtggatttatcgtcgagtgatttcttcctggcattttatctctgagaccaggatctggttgctaagcatgtagacatagaaatgcatttcttcattgaaccccataggttcaaactagtggataatgagcacaatgtcaatgtgattatttgtaatgggggaaaggttaccggagaatattacacgaccatccacatagactaacattttcctcatgactaagtttacttagcaaaacaaattaaaaacagaagtttgtttagcagcacagaattgaaggaagacaaccagatggttatgaggaagattcatccaaactatgccagaactgaaagaaattaagttcattcagtacaagaattgtctagaataagagaatccattttgtgtcagcacttcccaagttcttgttaatgctaccttaagttcaattcaaaccaggcagcatttattacgtgttgtgctgggtcctaggaggaccgcgttttaagaacttactgtgatcttctagatcaagtttttatttcaatatttctacctcatttctgattcttaggtgttccttatttcccaatttatcccctgcagaaattgaggcaataagatgtctatcttattgcctatggtgttgattatttatgttatattctgttttgtgaagtttgacctctacctaattaaattacattttcaattgtatcttggattgatttattcaataagtattctttaatatttttgcatgaggtcggtcaggtttcatcagacattaggaattaattataaaaatctctagattggtacttggagcttaaaggaataaggtggtggaacgttaaatgaggaggaaagaaccagcagagctgggataaaattcatctctatcatcttcccacctgcttgatctctggcatataatttactatccgtgaacctcaggtttctcttcagaaaagctgcagggttgttgggggaaataaggcaattcctgggcttcagtatgttcaaaacagagcattaatattattatagacttttgatgatttacacaattttagctttttggcaagacatatttactagtactaagtaaaagcacgttgactttctaaaatgaaaatgtgtatgtgaggatgaagaaaaagaaagtgttttgtttgataatatagcattataacactgcacaaaaaaaaaatggtatatgcagagacttccatcacttgcttatgatgccgcattgggatctcattaataagacacttcctcagacacttcctttgtgttcaataaatttcaatttcctcctttccttcagttcacttcaagaaggacggcagcaactttcttgttgccaaacctgacaaatgttttttagtgctgattatactcgagcattctgtagcaaaatgctgtgggtgaaaatgccttccttcttaagggaatttagcttctgtagtaccagaatctccttgttgaatgaacatgtactgcctaagtcttagtaatccctcctttttgagcccattttctggcatctctccctttaatattcctcaaaaagttggatttttcctggacttttcatattacagactttcctttggtcatcctcatccattccgtgattccaactacattttccctccatcctggcatcttctttcttccagacttgtatatgcaactgcttccattcatacacttgaccaaccttttaatttctataagatcaaaaactcagctcacaagctttcccctaccatcgagcggggttcttcttttgcttctttgtttcagacaatggcaccaccatactcgagtaaggcacgttcatttatcaggtcctaccaaatctacaataaactctcttgaatttatccacttgttttcatttgaacagtcatttctttacctgggtagcctgcaccttctacctgcattgattcagcagtctcttcaccactggctctccctccctctcctgcctctcttcttgctccttcaatttattctctactcttcatagtgacttttattaatgcaaatatgaccttataactcccttgcttaaagacccactcatgtttgtctttgtatccataacttccggcctagggcttaacgcatagcaggtgctcagtaaatctgtggtagatgaaagaacaagttgtataaatactgaatggtctgatgtgctctttgttgtgtcaagaaggacattttgcagtcaggatagctacatcagtcctttagtaggcatttgacagcactcgcattattcctcaagagaagatggatgtattgattctgtatttcaaatgacataacttttgtgaaataagaggctgccacggtaatctgagggatctctcaagttcaagggactccacagtgctttgtgtaaggtaacaggctaaagggttcagtcttaaactttcttaagactgtagttcagggttcctatggtggggctataaccctgaattacatcctctttcatttcatgctgataatgagaactacaaaccaaggggtattaggaaagaatccaggtttgatgcagggaaaaataaaaacaactgataatctctagtgtccccaacttcaagaattcctttcttctttacaccaagctttttttctctgccaggacttactttgtcttctacatgtttaagggagaaaaatgagttaacagaaggggaggtacagcatttctatttacttagatgctagagaacaggatgaaaggtatgaaaaatatgaaagtctctctctctctctctccccagccttcccccgcttctctctctctctctctctctctgtgtgtgtgtgtgtgtgtgcacgtgcgtgtgtgtgtgtgtcataatactcaacctttcttttctttcaagcatatgttgtggcagagacaagtgtacatcaaaattcgtggtccctctttcatagtatagagttcttgctaggatccagctgcaagccagcaactacatttcccagccccactggcatctagttagagccatgtgactagttgtgaccaattgaatgtgagtgggagttatgttgcaggcataccttttccatcttcttacttcccatttgctaaccttatggaaaagagtcccaaagacctaggagatgaaaaagcctaaaatggaaggactcagagtccctgaattactgggtagagaaaagctgtttgcagatgggaatgcccattttgtagtattctttcttttcttaagccactaaaattgtgggatctctttgttatagctactggcattaacctcttacgtatacatacagctatgtgctacaaagaggaatagatacattttttaatcgttgaaaggggagaaagaaacatatttaggaggaaaataatttagtctctacaattgaaaagtgttttatgaataatattttgttttggcagcatattaaatctcaggcagctgaactacattaattttcaattctctatatatgtttttgtcttcagggtttagtaacactgatatataacagtttctttcttttaatttccaaatttaaatgtctaagtttgccttctaggcagaaattaagtcccattgtggaatgagattggatcaacacttcaccaagatcattttagttctttgtaatcttaaatgaaataagctaataaagcattaaattagcatgttgtaaaacttcgtgaagttttaatatgcttctaagtggcagctcttagcttattatctctaaagctaaagtcaaaataaatgtctcagttgatgaaatggagatgaggcaacattttatcaaatttaacaaaatattttatatctgaattataaagtccagattatctagtaattatcatataaatgtatttaaccagacatgcatttttctctaatcagtagccctggagtctttggaccacaaatgtgccttatctcaaatgctttaactgtgacattttgctttagactagctcgactacttctacagaaattatacacttcattcacattcatccagatgaaaaaaatacatgtagaaatgatcataataagtaacatttgtttaggatttcagagtttacgaagggtttttctattcactttctcacttgttcttcatgtaaactggtttggtggacaactgtcattatccctgttacctggagcccctgggtcttagggagacttcttgacttctcaaggtcatgaaggtgctaactctgaccgtgtttttattcctactgtgccacacttctcaggtaaaaatcatattgcagacactttaagagaagtacttaagaaaataaattcctccagagaattacatttaagttgtttcattaactgcagtgcataaagaaaggaaaagtgttcccaaacccatgtagtattttgctattgcttatggtaatattctgcacacctaatattgtcagcataattttccatgtaacaaaatgtcctaaatcagcaatgtccaatataactttgtgtgatgataaaaatgttctgtctctgtgctgtccaatacaacagccactagatacacatgactactgagcaatggtaatatggccagggacactaaggaactaaatttttatttaatattaaataacgtttaaatttcaaaagccgcatgcggctagtggttgtcatcagatactgcagttatagaaaattagaatttacctctttaaatactaaacctatttttaatagtaggatttttaaattaaaatagttctaagtgcttttaagtgatacgaagtcaaatgcaagatttctgttttaatagtactctcaacccagagacaatcttcatgcatccttatacatgttctttgttgccttattctagttttattttaacattaaatgcctctgttctacttgatattgacttgcttcagagaacaccaagtatagtggaaagaaacacacacatgaggacttgaggctaccaaccaggttcaactaaatgcactctgatttaattgtagtattgggatcccctgttgcatttattgaagaagaaaaaaactttgcaaccaaaaagatatttgaaagcaactgttcttcttggacacatgatccctcataaagtggggcttcctgcttttcagagacttaatttctgttcatattcatttcagcaatagtaataatgatgatggcgatgatgataataatcatgatgatgcctaagtgttgtagtaatgcttcttctgagccagacgttagtcaaattactttctctacattaattcaggcaatcatcacaacaatcccacaggacaggttttattattatacttatttagctagcaaatgatataactaggttaagttacttgcccaaggtcatactgccaagacagtggctctagtgtccctgcttctgaccatatgttatgctgcctatcctagagcttttctcttctaaaatagtaaaataatatattctttgtttgtttcatacttttttttttttttttttttttgagagggagtttcgctctttcgcccaggctggagtgaggtggcgcaatctcagctgactgtaacctctgcccccaccaggttcgagtgattcccctgcctcagcctccgaagtacctgggataataggtgcccaccaccatgcctggctaatttttgtgttttcagtagagacagggcttcaccatgttgaccaggctggtctcgagttcctcagctctggcagtccgcccgccttggcctcccacagtgctgggattacatgcatgagccactacacccggcccatacataaatattttaagcgaagtacacatgcatgatcatcatacttttaataatttcatttaactgtttccaaagaatgttagtatgaggttttctttttttctttttataatttcaacttttattttagattcagcgggtacatgttccctggatatagtgcatgatgatgaggtttgctatatgaatgatcccaccacccaggtagcgagcatggtaaccactagttcttcaacccttgcctgttcccttcctccctccttcctctgtagtccccagtgtctattgttcctgtctttatgtccatgtgcactcaatgtttagctcccacttttaagcgagaacatgcagtactcgttgtctgttcctgcgttaacgtgcttaggatagtggcctccaattgcatccatgttgttgcacaggccatgattttgttagtttttatggctgtgtagtattccatggtgtatacgcgccacattctttatcctgtccaccattaatgggcacctaggttgattgcatgtctttgccattgtgaatagtgctgtgatgttatatgtactttttggtatattcaaagagaaatgctattttcctcttgacatatttatgtcaatttaacatatttatgtcccttttctttttaggagcaccattctcttcctttaacattataaataaaatattttttgcttttctgtttttgtaagtgcagttttattgacagagtgagacatacacgtcgatattgtgactagctgcatgtcttctattatttagaggtctcactcaaatgtagattatcaaattctgttagtgaagagggtagaacagcagaactaatgctggtttccttctctagcattatttgatgataaactaagatgataataccccccaggtcttagatacctgcagtaggacaggcaccctacatttaatgctcctaggaatccttcaaagtgatagcatagttattatacagtaattgagaaaactgatgttcataagttagaaatttttccgaagttgcaaagaaagtgaatggaagaattataccaagttctggccgggcgcagtagctcatgcctgtaatctcagcgcttcaggaggccgaggcgggcggatcatgaggtcaagagattgagaccatcctggccaacatggtgagaccccgtctttactaaaaatagtaaaattagctgggcgtggtggcacgcacctgtaatctcagctactcgggaggctgaggtaggagaatcacttgaacccgggaggcggagtttgcagtgagccgagatcgtgccattgcactccagcctgggcgacaagagcaaaactccgtctcagaagaaaaaaaaaaaaaaaaaaagaggattataccgagttctctttgattccaagcccaaacaaatccttttttgcaatatatgacattgtttccctgtttgcattccccattctgtgtatcacacatcctgtggcctgatcaaaattcattttcagattctgaatttattttccattgaatctatataaactataaagacagaagatatatgtatgtgtgtatacccacgtttctcttccagtgtcaactgataaaaatagatttcaaagtctcaataacctttaattccctttttctcttaaaaattctttagaacttgtacatgacattctgactctagcagattttagaaaacagagaggccattagatattcataccttactattcagatgaagtattcaatgctaaattatgtaatttatctgctttgcaaattgtatggtcagattgagttccacaaaggagagataatttttaatataggcattctgtagcttccctaattattgaattagtttagagcaaaatccttaaattgtatcgttgctatgctcaaattttgtatacttgtccacgtaggctatattaagatttcattgaattttggtttctttctcagtgataattcaatatatcaactcaccactcagatttgcctttgggaaaatccaggccccttttctggatttttagagcagattttaaaaaagtgattctgtatatgtgttgaaattaaccacatctcattgcttttgaatgattgaggtaatgtatacctactactttaaaaaaaatgacttacttagaaggtgtccatagttttataagttccattgaactggtttatattgtatttagaaaggaaaactactccttttatccttaagggtgaaaacctggattttattatacaattaacacatatttattttttattatgaaatatatcacaatataaacgtttacagggagtgtttaaagtggtgttgtccaatggaaatataatgtgagtcaaatacgtagttttcaattttctactagccatattagaaaaagaaacagagaaattaatgtaataggatactttatttagcctagtatatccaaatcacaattatttaaatatgtaatcaatataaaaattactaattatgtatttaacctttttctttagtaagtctctgaaatctagtgtatattttacatttatggcacattgcaatttgcattagtcacatttgaattgttcaatagccacaggtggctaatggctaccgtgttggacagcacaggtttaaagaataatatgaacatctgtgttccaacattctgagtttcaaataagaagaacaccatcagtattttgggagaagctccctatgttaccccttgctaatcaccttccttccccccagagccaaaagtaaccattatcttgaatttctagtaaacaatgctcattttttaaaaaacgtatgttcaacacctgtatttgtatctttaaagagtagctagttttagtttgcctggatttgaactttatattaagggaaccaccccatctctaatcttctctgtgaattcttttctctcaatactatgttttacatatttacgttcatcaatgtgcaactcattgtatgtatataacacaatgtatatattttacatgcgtatggacatttgggttgtttttatgtttttgttcatcacaaaccacaacacacatgtgttcttgtatatgttttatagtgcatgtttaaaaatttctcaacagtattcgctagtagtattgtcaggtcatagggtatgcacacataaatagaaatgattgattagctgcaatttgtagtgcacacatatttgctatgtaagtgatccatgtttaagactttaactgaatttaaaaaatattttattggagccaatctaaatgagctaagggtttgtattgtttacataagcaaagattacacttactgggtcaattcggttgattaactttggatatataaaatatatagctagttgttaaatagatataattattaattggcattacttttgtttgtatataaaaatttcaaaatatccatgacttaagcaaggtaaacacccactgggtggcttaagcaacagaaatgtatttcttgcagttccggaagttgaacgtctaagattaaggtgatgacagggttggtttctggtgagtcctcccccattggcttgcagatagccgccttctccttcatgacctttcctctgtgtatgtgcatcccttgtagctgttcttccttttatgaggacattagacttattggattaaggtcctacccatatgaactcatttaaccttaattacccctttaaaggccctacctccacttgcaggggttaaaacttcaacatatgaatggggttgaggagacctacttcagtccataacagtttctatattctgaagatggtctttaattaactaaacagttaatgttactttactgggaatgtcttttggatgggggaataagctgatgatatgagaagggttggtgaatttctcataagtgtgaaatttgttgggccggcccagcatgattttcaatcaaatacgctttggggacaagtaggttgaatcactacgagaggtttaaaagaaagcaagttgtaattgcaacttttaattgaaagaaagacaggctttgttgatgtgccagcaagactgataactggctttaacgtagatagtaaggcagcagattcaatccactgatcgtgatctactagtgaatttcaaagccttatgcaatagaactacaaaccctttccttgcccaccttgcaggtggatccataggcaaaatgaacatttgcaaaaaagccgctatgtttcagaatttgtgctagggctttaatatctataatttctccaaatcctcacaatttaagaattaattcaacttagccccatgaatagggtgaaaattctgagatttaacaaactaaaataagttatctgaagacagacaaatagaaagagttgagatattctatttgaatgtaaaattttcaaaaagtagaatgacagcgtcaggaattacagtctcagtgttgaacacaagacttaggaacaaatttgctgcatgtaatttcattgagatgggacaaagtacagcatacgtaaggaagttttagaacaaataagataattattttacgagctttgaaacatgtgtaagaaagatacgaataaaagtataatcacatttgactaaaacatgaataccttaaaactgaaaagcactgagattatcattatataattttgaatattttaaaccacaatgctttgggagtgcactgtaatattttagaattggaattttaacttactggcttaaaaagtaatgtactttgttttaaattcaaagattatcttgtaaattcagttcgatctattgaaaaaattataaaattcggcaagaagccaaagaagaacaattatgtagctcaagataattaaattttcatgtttggctttagaaatatattcgtcgtgacatagtacatggtaatctagtgagcccagacaagtagttttctctttttgtcaaagggaacaatttgatgcgtgttcaagttgcttaaataaaattttgtatgtgctttctcatcacaagagaacaatatgatttttgaaattatttttactttataaaagaaaaaaaaaagccctcacagagaaaaaagaaaaaaatgatgatgtctttgaaaaacaaagttaatacagctttacatatatttgacctacatcagggttaatatttttcaaggtgaaacattagatgctggaacttgcaaaaacaggcaatcctcctttagatgaaacggacactctaagggttaattcattcactgagacctattgtgaagtaagccctacagagactgaaaaagttaaatgcaactcacaaaagttgctagaagagtcatgatgttaaaataaaataagtacacaatgtatgctgcaagtatacttagagccatgctaggtgcggttgagaagttcaatacaggtccaagataatagctgcttctcctatagaacatgtcttctcattggagggataagacctgtgtctatgaaacaggcgtaattacatagctctggaactatatatgccgaaataaatgagacagtaagtgttattgtactataaagaatgaagaaatcatgatgagaagtaacagttaatgaatgttttctagaaagagtaggatctgaattggccttaggttgtaagcagagtttatagatagagtagtggtatgtcagagtcactctgggtgcttaaacatacaaatccccaagtctcacccaaatgtgtcttcagatgaaaggaaaaaacaaatgacttgagctcccccgcaaagaacacgggtggtatattgagcagccaaggagtgaccagagtggcaggcccatgttgagggacaaaagaggacaattagaatatgattaatacaaatttacagtgggatgagttgttagcctgaggagcttgaatgtgaacctctgtgcaaaaaggagtcattaaatacttttgaaaaaggtgggatgggaagaaaatgacattctcaagacaattagatcgaacagtattaagcatgctgacttattaagttatgcaccttgagagggtggaatgagggaaaagggtctttatctggagtaagacaggaagaagctaagctgtaattcttactggactgtaaattatgtgcagatatattatctgtcatgttcgtgggcgcattctcagtacatagcacttgaaacaggtactcgataaattgtcaaatggatgcatggagtgatttccatgcaaaatctaatattgtatagtattagaagggggaaaaaagcatggcattatgctagcagaaatgtcatttggtattgaggatgaaacattttcaacagtttgcaaagccatccactcaaacattctgtcactttccaataattttgaaggatgttctttctacttctaccttattacacaatgagttgagtaagataaagaagtcatgtgcaacaaaacagagggagattttctgaaaggcactacaccaggaagttgttgtactcttgcttcatcttgccatcttggatatacttctggcgctacctccaggccagttcctcgttacatatgtcatttacttcccacatgctagactcaccgagttaatcattttgctgcagttaacacattttagcagagtgtaggtttatgggtgagaaggaaatcaatgatgtttcaatacagggttcttttcccatcccccttatttccacttagaactgtctctcaagtcttaatttgcctctaaacttttttcccagcttacattcttttctgaaaaatgcaacgacgatgccaatgtttgttgacctgaaatacattgtaaaacattcataatactttgagcagagcttccaaactcccatttgcctcttttatctcccttaccttggcccctttttgaaggcaatgtgatatttaatccgtttctattgatgcttcaaaattattgaaaaactggtaattgtatttttccctttacttatcagttgctagttgacaatgagtgtttgcccaaacaataaccaatcaaaaggtaaaaaggagattccagacatatctgagaagaaattctttggaagaagcccgtaaatggaatgggaattcaaacaaagccgtttccaaaagaaatactaaatggtctctaaatgcaaaaggattgctccccaagcattttatgggagcataaaaagctcccaacacattttatgacaatacttctactcaatgacttcttgtgttgacatatttgttgcactcgacgttagtatttacagcttcttatcccaaatatttacttaactgaagccctgatgtttttaaaaacttttcatctgtgtttaacagcccattttacagaaacttatttgtttcatcaggcagatatttactgagaacttgcaagtgccatatattctaaaaatgctgatgataaaactgtgaacacaatagattctcatggtgcttatggtcagggctagcacacacacttgtgaaatgatcactgatgatcaaaggcataaacactacatttggaagaaataccgagggatccagaagtatcttggaaacactagcaagtatagcagatggtgggattggtgcttcaaagaacttcttgtggaagatgttacgtatgtaccttctctgtgccaggcactgctaggaagtgctggagagaaaaagatgtgctagataccgcctctgtcctatgtgcttgtgctttgtggggaggtgagtaggataatcccagttctcatgcagtgtaatgagtaccatgacggaaatgcactccaagaactaggcagcatgaccagagataggacatttgagaaagacttcactcgggtggtactatcttagtctgggtgctaaaatagatgtgatagatgagtaagggtgacccggaagcaggagggaaagggaggggctttcagaacaacaagtgcgaggacattaaggtgaaatagagtataatagtattcccagatccttgggattgttctccattaggctaaaacaaaggtgttttctcttctttaagatttcatgactgcagattgcataacagaaggtcatttaatagacctctaaactgaaggaattcttgaattaaatcacaacatatcttccatggccagagaaaccattgcctccttatgtcgacattactaacagcaccagcacctgctgctcaggccagcgggagggttgggtgttgctgcctaggtaatgctcaccaactgatgtcctgccatgagtagttttgccaagttccacaaaaaaaacttagtgttctatcagcatctaatgagaattacagtcattagttaaataaaagaactattagataaggagcagaatgaacaacacacaatccatcagcttggtgaatggtatcagatggtttctgggtgctgggcagctgtgcatccaagtagacagggagaatatatatgtcctttgccttatgtacttgtttctctaatccaaaggcacagcaatccgtggaagctgctatgataaggtgtttagtggtgaaaatgtcttgaaagccagtagattattaaagtgatgtttttaaaaatgcagatggagagtaagtactttttatctagagtagtagttctcaaagggaggtcccgggatcagcagcgttagcatcacttgggaacttagacctgcatgggccccattccagatctcacttgaaaactctagggggtgtagcccggcagtctttgttgtgaccagctctccagggggttctgacactccaaatgttcaagtttcagaacgctactcacaggccatcatgctcggcatcacctgaaagcttgttagaactagaaagtcttggccccaccccaagcctactaaatcagagtttttgggagtagggccaagaaaactgtgggttaacaaggtctccaagtgattcttattcatgtcaaaatttgaaaagcgtcgatcgaactgttggttctcagctttgattgcgtatctgaatcacctggggagacagttgagctattccgggcccagatcacatctagaccaattgaatcagaatctatggaggcaggacccagacatcagtattttaaaatatttcttgaatgatcccagagtgtagctaaggttgagaaacactgttctaggattaaaggattaatgtgtttgagagtatgttaagatcttaggcaaatcacaagggtgttaagaactaccatcttcgcaaaaggagaatgtgcctcagatattctggtactgctttgattttaccttcagtagtcttacctattttgagtatgcttagtagtactaatatgaggcttattactaatatgttaaaatttgtcttttaattaagtgggtctaaacgttttaatctttaatctctgacccaactagaacttttctaaacattttcataatagtctccaccttgtcttctgaccttcacttatgttctttcagggttcttcgtgtgttactagtaatagtaatggcaagtgtttattgaacacttactatgtgaagattctaactggcttttaataatcacatcagctctgggaggtagaaggtagggatcctccttgcttatcaggtgagaaaactgtactatagagaagttagcaacttttcccaggtcataatatgtgacagctaaagggagcataatggttggaataaaataaatctactctagttgtaccgaaggctcatatttgtctcacgtacttgatttggtcgaggcccaaggggtcaatttccaatgcttggattcctggatatgtagagttgtattaaaaatgctaaaaacctattatgtatcatacaatcatacatatcacctaaagtattatggaaatgaatctgtattattaagggaaaaaggcctgtgtgaagaacaactgaaacttcattttaattgaaattaaataacatgcatcatacactaaaagtgcacgttatgaccccatgaattacttcaggtggctttgattcatgttacatacactaacaaatatagaagagtgatataatgcttcttaattaactactaatggaagtttactatttaactgcttcttatgtaagaatgtaaatgttttctgaaatatcagaacttttcattaggaagcacttttaaaaatagcaaaactgatatgcactatgatttccatatacattaaattgaacttgtaaatgatgttataaattatagaaaccaaggggatgttcaaattagatatttgtctaaataaatcatgtatggattgaacaaatactcattgagaaataaatgtattccttttctttcaattatctaggattccttgtttatctcttcagaagcaaaatgtcttctgtccgttttatttccagttaaacattcttcagattatgtaaataagttaacttccaatcctcttatttctgtttatctcaccactcttctaatttagacgtgatcaatatcttatctttttgcatttcatagacatcaggatccagaataattgagtgagctcaaaacaacaatggcaagaatgatgttttcagaaaactcagcaatcattcgtttaataaatattcattgcctaccaactataagcaaagtattggctaggccatgtggggtatacaaaaatgtattaaatatggctcattctccctaagaacttacacctattagacaaagtacatgcataaaaattataatgtataatagaaaataaatacaagccctagaatgcacagttgaagtacgatttgcatttattataaaaagaaagatgaattggctgggcacggtggctcacgcctgtaatcccagcactttgggaggccaaggtgggcagatcacgaggtcaggagttcgagaccatcctggccaacatggtgaaactctatctctactaaatatacaaaaattagccgggtttggtggtatgcacctgtaatcccagctacttagcaggctgaggcaggagaattgtttgaacctgggaggtggaggttgcagtgagccaagatctggccattgcactccagcctgggcaacagcaagattccatctcaaaaaaaaaaaaaggaaagaaaagaaaagattaatttcctgttagctaaatcaaggaaggcttcatggagaaaaaaatatttcaacacacacttgacgtagcagtgggatcaggctgatgttagggaagaatgaatgacattctacactgagaaagagatattcagtatatatatgaagagcagtagagaaactaacaagtggaaatagactcaatttacaatacttgcctgcctggagtactctatacgttgactgtaagttgcagtttactcagaacaatcccactttctacttgtttatcctatgtaatcatttattgggcctccttttgctctcaaaaatatccttgtttggataatagattatcactctgttcctaaatgaactgccctgtgtcctatcccagtaaaagggtgcattcgggcccttcgtaactgcctccactacatggttgattgaaaccagagcttggcattaagaagttagctgaacaatcagatttctattcttggaaaacccaagaatttcagaatagatacagaagctgtatagctttaataacatgacagagttgtagccttgaaagctatgtacaattcagaattatgagggagaagaaattgaagaaacagtagcagccgggtaaatgcagaaacaaatgagggagacacctagggggtgactgaggcacaataatggaagagaagtgcagtgaaattgcttgaactcttactgatgagatttctactgttgccttgaatccaggaccacctatatgttcattctttgtcatgctcagagttatgacagatgctgttattgaattccccagagactcccttatcgtctcacctcaaaccttacaataatcccttctatctttctatccatccaagctggcttaagtaaagtctatgatccatattcctagtaaacagagaagggaaagagactgaaggcaaaggccccaattagtaggctattgcaatatttcagggaaaaggcaatggccatcacattgttgtcccaggaatgagaatagaaatgaaagaagataatgaaagttgaaaggactgggggggcttgacaactgtttagacttgaggagtcagataaaataggaagccaaagataattcagaatattttgattttgattttcatcaccaaataagatagtagtactatgaagaaaaaatggttaaaaaacaataataataaagagaactcctccaaatagtaccaagggagggagtttaatagaggaaattaattccgtaggtgatgagagtcctgagaagccaaacgagaaaagatcaaaacaacccagggattggcagtcgcaggaagctgttctcacttatggctggggctttaagcacaaggtgacatgagatttcagaatttgaagtcgtctggaggcagctaggatcaggtggggcctgtcctgttcggcaggacctgcaaccacaggaggaggatgcgtcaagcagaaagttggaacacaagaggggattcagccataagccacaaaataccttccagagcagagagaaggagaaataccctgaattccgtattttccctgccatttagttccctgctattgccacacattgacgtattccatccagagaagtccattggcatatgagtctgggaaatgtagttcccagggggacatgatcttaagggaaatagacaatgactggtgcaacaactgacctgtgtgaggcaggagggaaaaaacaggaataatatagtttttctctagatcccttcatgcacaaagatgcaaaagaaatgtgttggcttaatgagccattctgggtggccctgtaggtggctgtcctacgaataagatttttagacaaaacagagatgacttcaaatgtcacaagaaaagtatcagacaggaattaatattgacttgatctgtcacaggcgtcaatgatttgcattaagccaacgatcttcattgttaatgtctgggaaattgccagcagcattacgactacttgtgtggattagtgtaacggattcccccactaacattcaggaaatcatgtcaagcacagagtgcctatgtaagagtggttgtgtctattcactacatttcttggactaataacacacttagccttcctgaattgccaacatgtacaaaaccagattggggttttttagttgttcatggaactatcatttattgggtagctcctgtagaagcaagatacagaaactctaattaggaataagacagtccctgtacttcaaagagctctcaggggaggcacacaagtaaacaagcaattattatcatacgttaggataataccgtcatggtgataaccactgagtgatagccaaacacatggaagaggtacccaagtctaacttggggtagtcagagactgctttcaaggatatccgagtaagtgttagctaagacatgatacgtatttctaggagggaaattttcaaggcaaggtggagattgtgcagtgacgcccagagcctggattattttggtgactgctagtatttcagaatgacttcagcaaaagttgtagagaagatagaagacaacaaagtataagcagaggccagataatgaggacctggaacagtggtttgctggtaaatgtttaacaagaggctcttggcggggagagagagtgtctgatttgcagcatttggcaaattttgttgcacaaatgctccagcatagccaatttcaagctaccagtgtgacgtcattgaatgcagaattggaaagaaacgggcagtagcacagcattgtatagttattttcattacccagatataatagataaaatatccagatggtatttaatagatatggatgcaaaatttaaatatatgtacattcatgtgcttcatgttactgaatgcgcacaacattcattatccattcattcacgtgttaatttaacaaacatttctgagcctctgctctgtgccaaacgcagttctagctgctggaattacagcactgaaaaaaaaaatttgtcctcactgaggtaagacaaacattattatgcccattttacagctgagaaattaagacatatgaggattaagcagtatagttaaaatcacacaattggtacatgaaggaatcaaagaggaaatcagctctcagattttaaatccagggactcgtttctgctataccatactacctacctagttgagctggattttatcatggtttccctatttttatcaccatgtggttggataagtaaaataaatatatgtgacctttcaaataaatttgggtcatttttcttggaagctcatctggtgtgaactttaaaatactgcaattaataatgattataataccctggaactctgtagcaacctcttttgaagaactccaaggagcctctaaatgtatcaaactaagttcttcaagtgaattagttatcatctgagagtaatatagacttttaaaaatgcattaattgtattaaccctttcaggcccatagacttaagtgtttctttctccaaataaaaatagtaatctctgtccattttctttagagaataatgaagtaattttcattgaatatgtagtcaacataattacttcaattcaatcgtgaaggattttaaaaattatttatgtctactaacttaaagacatgcatagatttcaagaacttaaaaatgcatattgcctctttgccctatgcctcataaaacaaaattatgataacgttgtgtgttacagaaaaacgcactgattgtaatgaagggtgcttcaaaggccatgaacttggaaagcaacttatttacagagacccccagcaatagcagctaaaagattgactgactccctttattttcagttatccttcagacacttttgacctcttcctgtgcctttctagtcatgtgcaatcttgtggatatctcttccttcctcttgttattttctatttcctctgtttctatttgtttctaaaaataatcatgtttgaatataggattagcttccttcccatctccccattaccaatctctcactataccgctatgttattaatcttcctgagaaatatatcaggttcattacattagttaccagctcaaaacgtatcagtggctttctagtcctcacaggctcaagttaatctgcatattctgactttcatattctgggttcatgcaaacttttcaactttccctcttatacctacttaggaggaccctcaggttccatcatgctcatgtttcaagccagaagttctcctgcctcttcctctatgtagactccacatagactatgatatcctgcttctcttttaatcctccatcttcagctcacagccacactcctctgtgaacagttaaatgattctcccacctcttacctcctatagcacttatttttcatgcagcatttttgagacttaattaaatctacagttttaaaaaatgtttttctaccacagtctcttattcatactaaaactttcaagtctatccattttgcttatacaaccacaccgttaggtcttttaggtccaagaatacaagagaatggcaaagcacgttgtttacatccacacatactgtgtaaattcaggtaattttttttaatcctatgatcctcaattacctcacctgtaaaataggtactactcatactgcagaactcttgttggaattaaataaatgagtgtattaaaaatgctcaacaagatttggcacaaaatcggtactcagtaaatgctaatcattattccctttctcttcaaagctccacaattctgtattcatatcaccctctttatatcatttgcaaaaatgtatcctattccaactctttccacctagcctcaacatttacaaacactcctggtgggaagggaaagcttttgaggagagcacatctatactcatttacttctcagggatgcaagctgccctgcttactgagggcatatgttcatagtcacaccggagcccactgtccccttatactctcaaatgggcagtagcaaatcatcttgatcggtagtaatgacctgtctctaaattttcacatgcatcagataatttcttttttagtaagtgttatcttacatatatgccaaaatatcaccattatatggaacactagctgaaagaaaaattattcagtagtcttaattttctagctaacataaattctctccattttcatcatccatttagattaaagactttactgttagctgaatattcagagactttattctgatttttaaaatttatgaggttcataatgttaagacttcaagggtgagctgtttgtgtcatttataatgcgtgactagacagtaactagaaaatggattgttgactttacaagatttctccccaccacgtccccccaaacctgtgctgctgtgtatttggcctgaaatctttacttctagtcaatctttggacctaaagcctaccagcttttagcatcctttaagattgacgtgtctctgggagaccaatagatgctaaaccaaatttcgtatgcacttggcaatataggataataacaaccatactccctgcaattgtttcctaacacagatgtaacaaattaccacaagctgggtggcttaatagacatttattctctcacaaatctggaagctaggtgtccaaaatcaaggtcaattatccctctgaaggctctggggaagaattcttccttgcctcttccagcttctggtagccccaggtgttccttgatttcaagcagcacaagttcaacatctgctcctgacctcacataaccctcttctttgtgtgtctttctgtgtccactcttttctttattattattattattattattattattattattatactttaagttttagggtacatgtgcacaatgtgcaggttagttacatatgtatgcatgtgccatgctggtgtgctgcacccattagctcatcatttagcattaggtatatctcctaatgctatccctccccccctccccccaccccacaacagtccccagagtgtgatgttcccattcctgtgtccatgtgttctcattgttcaattcccacctgtgagtgagagtatgcagtgtttggttttttgttcttgcgatagtttactgagaatgatgatttccaatttcatccatgtctctacaaagaacatgaactcatcatttttttatggctgcatagtattccatggtgtatatgtgccacattttcttaatccagtctatcattgttggacatttgggttggttccaagtctttgctattgtgaatagtgccgcaaaaggacaccagtctttggatttagagcccaccctaaattcatggtgatgtcattttgaaattcttaactaattacatcttcaaagaccctatttccaaatctggtgacattcaaggtttcagggacatgtgactattcaggggaaactattcatcccaccacatcccccttgaaaattctggaaaatgtagtaataaaggcttctgataaattagtgtggaaagtattcacggttataaattactaaaaagtctcactgtgagctcttaatcaaaaggccctataaaacatttatttgcttgattaaaactacacatccgatattttggttttggatttattattatttttagacttggaataactattttatgtgaaatagattccataactgaagcagcatacctctcaatttcccaacatttattttattattttttgtcttcacactacttaataactgaggaaaaatcatttagaccaaagttcaccttggttgacaccatccagacagctacaggaaataacaatggaaactaaatctctaagaaaaagagtctttcatgtgaaatattgcagagttgattctagatatatagctgttggaagaatggatactattacatagatatggcagagtggtatccagcacctttcaacaaagatctttcagagtcagtcttattatgtctggagaatttacccagggcttaggtgcttttactgacaatctaaccacctgcaccccacccaccgtctaaagctaaagtttattggaagacttaggaaatcagtcttcggaatgtttctgagactggtacacccaccacttcattaaagtgcttcacttcacttcattagacaagaagtaaaatacttgtcaggaaattatttatagtaccatgtatatgggtatcttatttaatactacttaatgatggtactacaagttatataaaatggagaaataagtcatcaagtttgacaataatgatatttgatattatcattatcttttttattcgttcccacagaagtactctgttattggtttagaaaaatgatatttgatataataaagaaggaaaaggtggtaatattctttattttttgtatctttataccccagctctttcaccaatctcccccatctctgtagttctcctctggtgtccccaggcagtgaactattcccagtggttagggaacatctcattgagtaagttacatcaacatttcttcacatttcaggacaacaggaacagtgccaaatcctagcccattgttcaactctcaagccttattatcctaataacacatccatcccaagaaagaattcatcaagatcagagaggaatacgtataattttttatagtacagtatttaaaatgaaacagcttttggcccgcgtggtctcagtgggctcaagggggaaattcaggatgctagctcatctcacaccaagtttaataaagggtgtcctataaaaagctaatttcttgctggtaaattgctttttaagtaatccttgctgttgcaagagacccattcatagcgctgacactgggagccatgttggaaaggctagatatgctctgggagataaggtaagatccaggtggaatcttctctttacagaatgacaatgtatatagctaatattgtcctttgaggctagtttgcatgcagttgctggtatggcactgctcagcagcctgctgcagataagaatgagtgatgatgccctagattttaatggaacttttagagtgcatgcagcagtggggtgcagtcttcagcaaagaaaaacgagctgacttgcaggcatgagagatcatcaagaaagataaagaaataggacatccactctaggttaggcaaggctttttagaggatattatggaaatgagcaagaaccaatttaatttttataatgccactccatttaactttaaaatacaaggtcaaggtactgtgtttttcataatgattaaagatttggagcactctttctgttgaaacatactgcatctgtttggcagaaaaaaaaagtgacaaagaataaaactgggatcagagaacaacaaaaacatattctgtcacttgcctaacacaagttaaaaagcaaaggaaaaagagacaactctgatggacatgttcatccttatcccaacagaaggatttatttacctaaggtcctattatttcaagttactttgatcccaggatggtaacataaaatgtacattttaaaataaaatggaagtataagatcaataaaaaccacatatctgtggataaaacagcagattcaatcttgtggctgaaagtttgctttaacccaacatttggtaaactattcactctgtaatttattaaaagacatactgttattataaaactatctcagtttgcatcttgttggttctgtcaaaatttcatcctgctaattctcaacttgtaatatctctgatatacatgattaatctattttaggaataaaacaaaaactacctttatcttacgcatttctaggaagtgtttttagatgtaaagtaggggtaattgtagtatagtggaaaggattttgaacttgaagccagaacatatgtctctgccaaaaactaggtgtgtgaccttaaataagttacttagcttcctgaatcttagtttgtttagcttttttctataaagtggcacacctatccacatcacagttttgttgtcaaaattaaataaaatactatattagaaagaaacttttagaaagaaatttataaactgaaatgtactatacaagtttaaatcattctcattattttcttaccctaaaattttgaccttatttttcttagcaaatggctgaatctgtaaaatttaacccccacgcagcatctggattcaagagaactacggtcatttctttatacagaatactaattatacacatatagcaaaacacaagttttttccaactactctgtgtttttaaagattcagtgtgggcagaaggaattttatcaactatgttaggggaaaaaagtctgaagaaatgaaaataatgagaaaaagcactgttgatttaagtgcaggaacataaaacttcaaggcaaatgtgaggccaactgagttcatatatatcctcacaaaatgatttagttaatttaaaaacttttctaataagcaacacaggtaatcccaaattctatcttttatagctctaagagtccccataatttattcagcaattatttaccacccacttattataagaaaagccctgggataagtcttgagaagaaactaacaaaaacaaaacttgattgtttgctctcaaaaagctgggtctaaaataggcaaggtaagattttgttttgaggagcccgtattttccagcactgtccattgtaacattaaaatagtttgccaaaatcctcactctgtgggtgtatttgcctagggtgctaaaattgcttaaaaactttgttatttggctaactaaaatcactgaatagtaaacagtagcattagagatggcagagacattaggtgtcatgcagttcaactgcttcacctagcagacaaagacattaagttccatttcttaaatttaactatctggttgaggatacacagtagcagagctaaatcaagaacctcttggggttagagtttttgtttatgcattactttgttttggaattaaaaacagtgcctgtttgctaagttaaattgaaaatatgctctgaaggagaaaaacagctataaaaatagacttaacttccaaactatggatcacaataaactaaagaaataatttctgtagcaataaactccaacactttccataggaccagaaaggcttgagaaagaggagaacaaaaaaatgctttggggcttaccatatatatggagaaagctaaatgaataaaccagttgaaagacagcgagttatactagtaacaatattactgatatcggagctctcacttataaattgtatattatgatcatagtgactaggtactttatatctgctttctcattccttcctcacattaattcacatgtaggacagattacctcttctgtttctatccagaggcctagagctcaggccctcatcgaagacagacagagctatcatccttattctaaaaaaaaactaagaccccagacatagctgtgctacttatagactagaatgtgagagaaaaagacaagctttcatcatgggcttaacaaactgaaacacttcttcaattttgagattgagaaacttagctaatgctaggtgtaaagatgatatgctaccttcataaccttggtgaggagaaattagcatttctctcagtcctagaaggaggatgaccatgaaggtcttcattctcttgagaagataatcaaatgcttcactgccctgttaacggtttactcaatattcaccaagaaaagtagatgggattatttttgcagacacttatacgggtaatttattctgataagcagagacatacctttagtgcataaattgttccctttgtgctctttgtaataaacatcaccatagagaacaaacacgaagtaatgacattgaattaaaagacaccatagaggcaacagcgactggaatttgtgaaagtaaaaggatagtgcaaacagttgtgcgttgcattctgctctgaagattaacaagctgggtcaggctttgaccatcatgatgagcaggagatttttctaatggaaatccccaatcaagttcctgctgcacccagaaaggaacggcttacagaaatcttacatttctttgcacataccaaattgcttggcatattctatcacaaggtttactttccagggaatgtgatcaagaaatcatgatcctaattcctagttaaccctcaaagtttctcagaacagtcagtgcatcactgtcaacttttgtgcaatgtggaaatcagaattggtcacacgtttttccggccactgttttagattcatataatattagtgaaatcatgtcagactggtatagccatgaatttatacttcatgaataggcactcaataaatagtggattaaatcgaccgatttgatttttacctccaataatttcaaaaatatcattgaagacaaggttgttgaagctgtcacttttcttgctgaacctttgttgtgccaggaggaacagatggtaaaatcaaaagtgattagagaatcagtggggtgggggtgagattggaggggagaggtcttcccagtgagacccgctagcgtcttccctgagcagtatgttaacccaagacaattttagaaatctgtgcccctaagttgcttgacatccaaagcacacttgatgcatcctacatttctaaatatttttattgttgtttctcggtagtaatcatctggtttagtcactctaaaagtcaaggatgaaattttaaaatgcaaataaaagtgcctactttctctctttccaattcctttttgttttattgaggtataatttacatgcacaaaaaaatcgcctttttaaagtgtacagtttgatgagttttgacaaacatatgcagtcctacaaccacgtccgtgatcagaataggaaatatttttatcacttcaaaaagtttccttgtactcccgttgcagtcagtctcctgccccaccccagcccctggaaaccactgataggtaaaagcacttttaatctgaaaggtatttaatgtatggcagtgtcagtggtaataataacaagatttattcattggttcactgtatttttgagcacttatatgtgcccgttgtatgcaacccattatgctcaacccctgccctcctcaccagggataaactagtggcagagatagacaaagaagccgtctctctatcacccctatcttatagaacattcttcaatgttagaaatgcagtataatgtggccattgagaacttgaaatgtgcttagtgggaatgaagaactgaagttttaactttatttaatttcaattaatttaaatttatatagccacatgtggctaatgactatcccactggaaagtacagcttctatacaatatgataatatgatacattataacgcaggagtttaaccaagtgctaaagctttactatcaccagggtcactggtgttatgtgaaaagaaaacttacaatagaaaaataaatcctttaaatagtcacagacctgagaaagtttccttctcaagggaacacacattggctcattcaaaggaggttaaaaactagcatttaaggtaatttcatgaagctttcctttggatttctcatgcttattgtatacataaataggcaattttcgatgggacctaataaatcactgttttttatttgaacattttaacaaaattatcaaacagcattgcatttatgttcaacctatttgttctgagaaagacaacgattaagtagaagtcatcaaagttaccagaacaatttttgttcttatgttttagaaggcattgaaggtgtttaaaatgtacacttatagagtcagagtactatgcaactgtggcccttatagtttatccgtcatgcatctaaagccattgttacatctgtttctaattgtgcatggattgtccaagatacacaattggaaattccattttatttatcaatttgaagaggtttcacccatgtggtcactatgatcactatggagtcacattaaattgagaagtctccagaagttgcagtatttatttaaaattctaactttcttcagaggaacaaattctccatttctggattctgaatcctcattagccataaggttgttgtaagaatttgcagctaataggaacacatcctggggagagaccagttgaaaagtaacttggttctgagtgaaattatacagagacagtttctacttcaggtggtgttgctaatgaagctatcatggtaattttagcccatatgatccctaaacgacttcagaaccacttttcatccactaagaacccacttcaaccactgccacgttcactaccacagtataatatggaacaccctctggaattcagtaagtaacttcttaactcattggctatagagctttgcctttgtaaattctttccttttgcagtaaaagagattgtttcaaagtaatccaattagtccctaggcatgtctagaaaggtagagtcaacaacagtaaggtaatagtccttataagatatgtaagaaattatcagtcatttactttaaaataatttgtacacttttccttttatatggttcttctatgttgaagccagtggtcatccagtgattaagattagccaaactcaaaaggctaaaactaaattcaaatggtattattttgctttaattttatgcaatgctatgtatttaaatttcatgaaagtttcgtatggcattgctatcaatttcagtcaggataaatttcccgtgaaataatccacaattttcaactgtacgttgggtacaggtaaggaaacacccttaagagcttatccagttattagctggtattataaatttcaagtaattcaatgttcaattaataaacagttactttaaatgggaaagtatgagtcaagagttagtacaaaggagaatcttaaaagatgaacatcaaagaatcttactattgatttgttggtgcctttgcttgcacttctccaaattgacttgacgttttaaatttgtactgataatcatcagagtcaaatctgcttttaggcaaaaagtatccgctagttattcccctactatgaaagtgatgagatgaattgatcatgtctccagtgtatggatggatgtctttgaggaagacctactgaccttatgtttatcttctgtcagcatggtgtgactatgtggagagacagtgctatttgctaaatactttgtttttcaaataaaaagatttcacagattatgcattgtagaatttataagtattcttttatgtctttgaatgtgccaatacaatttttatgaagttggaactattttatctattttaatgaaattgtaagccttctgtgaattcttttattaattttattctgaagaaaatctgaccaggttagggaaatcaggtcaggttacgacgtgatcccagtggaaaagctgaactgtggactgtgatttaaaatagggaagaggtactgaagtgttgtttttatttttgtttacaaatcagcctttctaactattatgtactcccatccttctatctttttctccaccagaacgtattaacaggcatgcatataattaatgcttttcttgagataatattaaaattaacttcatctgtcaggccgtctgggctaaaagtacacagtcagatctgggtaacatttgagttgatgtaaatatgcccacacatactgacaatgcttaccatttattgtgtgaatgaaaagcagtgtaaatattgtttgttctactagggaagctccacattttaatcaaactttgaccgtatttctaaaatgccagagcatctggaattgttaaaggaactgatagtttttgtgtttttaactgttaggatacttgaaatccaaagggtaaagaaactcagctgatttatacgtttcttcctctttattttaatgtgataaaatgtagtttttgtcatgggctgacaaacagtggtagactacactaactctgcgtttgctgggtttaatcttaccctctcaaggcatggaatgggagctcacttcagacccagccatgcttcactgtccactgccttctcatggatatagtgtgaacattaattagatgaattccataaagtgctttaagctctttggagaaagatactcgctgcataattattcttaactcccatacgctcttatgatataaaccattctgccaggaaatcctttttagggattatcacttaaaatgaaattttcattattaaaagcaggaagaatatacatctactgacagacgaaaatgtgcttaaggcgactgcttttaaataggcagaaatcctgaactatggagccatccatgcctgaaaatactgagtaataatgaaaactggtagcaaatttggaatattaatcatcacattaagttgcaaagaaaaaaaaatacaagccacatgccctttaaaaatacgtgcacaaatctttattctagaaatatataactttaggcctaaaaaagtacaaaaagtaaattattttatggctctgaaagtatccttaatttactcaggtgacaacaattagtgtttaaagagttagttttcaatcttagctacaagttggaattactctggaagctctaaaaaaacaaaaaacaaaaaaaaatagagatgcctagttcccacctgcagaaattctgatttgatttttctggtgcgagacctgagaataggaatttttttaaagcttccctagtgattctagtgtgccacctaggttgccttaaggtaaacctcatattatgcagaacctagcaatcacctatcctgattttatagacgaagatcataagacccaagagggcaaattgatttattcaagattgaatatacaaatgatagaagattcacataagatgcagtatacagagtggcttgtggattcttgccaatgcaggcagcagaattttctttagggttcacccagttcaggcacctctttgcagcagcacttgactaaggttcttctgattggatcattatatgggcaaaaagaaaaagcttaattgaaaagagctgaacccacattgtggaatggaagatatacagtttacacgttataaatgattaatattcatgaaagcatactgccctttcctcttcccttcccatagatgacatcattgcattggtgtagttaggttggtggtttcttgttgttgatcttggttctgacacagttcatcacttattatcctggcttattatctacttctacattcattgttcactcactcactaattaattcaacatggtttttattgttttggaccggttatatgcctgcaacgctacgtaaggctgaggatattacaatgaacaggaaacaaccctgaagtttaaggtatcaagcctttgagttactgtcttttatcatagctgatataaaattgaagccccactttttttgttttcaattactgaaaattcagtgctaaaaaaatgtggatttttattcaactagataaagtactacaattaggtttccactgaccttggctgtttttgttcccagttgccattacataaatctgtgccactcacaacttaggaagggtgtaacattctctgtaatagtttgcctttcgaatagtgtttggattcattactgtccctcgcagtttggaataatgaccactgaataatcagtgtttggagactaaattagtgctgcaaaattccctcaaattacctactgttcttttccctgtcgatgtatcctcatattcactatgattaccctgagaagaaagatattgttgagaaccactttacctactcgaagttttggtatttcaaagattcatacttatgtcatgttgattacattagcactaatactattggcagaattctaattcacgttattttctttttttccaatttctctccatgcctatgtgttgtcccttcgcagctataaagccatggccgattcatgggtgcttttgttaaggcgttcagcagtcacgtttgtagatttttgaatgggacttagagcccttttttgttctttatgtatttctctatttctcagcaaaggaaatgcagacatgcaagaaatagtgatcaaatgtcctgtgtactattgtgggtgtcattaatggtatagggagaaatagaaaatagttgcaaagatgcatttaacaaataaacgaggtcttgagattcaccatgaatgtggccccttctatgaaaagtagttaacatccaactgcaaagttgtactggatcagtttgactttaacctttagctaatatgaaaatatggaattgtgtggtggtgctcacaaaaaagaaaactcatttttcttaattatcatcaattaacatgtactgactacccatgagggaaagttaatttgctcttgagtggaaccagttatttgccctattatttctcccttgcttattcccctctccctccctcctccctttccattcaacaaagaaaaatagataaagcaatttctgattagccagtgaaagcctctaacataaaatttccaaagatgtgccataaattatccacaaaatgtaaaacttttcaattttggtttgcattttcttttttcttattataaaggtaataagtgctcattatagaatttgaaaaatataggaagttgcacggaagacgaataaaatcagccataatcctacaaacctattgacacttgtacatatgtttgttatctctaatgcattcattatgataatgcatcttttcaaccaatagagtaatcactggtgactttcaaatttgcctactcatttttcactctgtggacttactttactacctcttgccctttttcagtaaatgaataaatatttaagtaagtaaatacaaatgtaataacttatgcgctcaagcacacagatacacacagagagaatttggaacttcggaaatgccatcctctccctagggccgcaagtgagttgataagcacgtaaggaaggataatcaggggagccttctcgtattgcccagatggctcaaaattcgtcatctctaccaaacaactatttggagctttgaagaaatatccatgacccctttgaattcttcagtttctttcgcgttcactttgagaaccaagtgacaagtgaatttcctgacttggtcttttaaacctgttagcgcagttccattgagattttgtgggcacaagattgcaatgaagagatcaacagggagaaattcatttccctatatatgtgcgattaatccggagtgctaagggcagatataaagcaggtgcctactcctgtataacttggaataaaaccatttccaaaggctgatgatcctcaagtcttgttctgcaaatgactgatgtataacttcaggccaatttttctccagttagtctgtgtcactgggagtcccatttctcggggagcagccccatgctttgtcaggtgcggagcccacagaaggttaatgcgaaaagaaggcctcttgccagactgttttccagatgatacgtagggttattagtttgagctccttaagaagatttttctcacctgtcctaccaacttatgtttatttcattggtgttagagggtttcagtggcggaagtaaaatatttagcggggaagggacagcgttcatgggaattttgcctaacttaattttgtatctttagctcattcgtagtcattgtactttgtgttttgtcaactgaattttgtttgcatacaaaggcacaaaatgtttgcttcagacctgtcactcttatttttagcatggttagacaaaaactgagatgctttaattgtctaacttatcccagtttaagtgctgcaaaatctcccaggcaatgtcatgggcaactaagggataaaatcagagatttaaaggtgccaggtttcccacgcttctaacagttggcgttttgggtgtatacaatccctcagctttcttctttagtttatggagtcttgtggagggaatagcaggtttttagctaaaattatcatgctgtcgagttgggtctctagtgcatcctgaagagcttgcattatttacagaggctgggctatcattttaaatcctgatgcttcaatgcccgttatcattcttgacaaactcttccagcccgtggtctgttttcctctgtttgcttccatttactttcctgagcaaccagctgagcaaagatttacataacttttgtttaaacaaaccctgtacagttcactctttcagccagtatgtaaacacttttgagacacagttacatttttctattttagtcccagattctgtttatttgctacattttttgtgcccacatttttgtctttgttaagtctcttacagattcacatgaaaaaccagaaaccgtggctgctcaaaagtcattaataatgagatttttagctactgtttctgcttgtaaattcttcatttcacataatacagtctcaaaaggccacagagaattcagcctcgcttatctctgtgttgcagatgatggcttctagccttacccaatcccagtgcagcttgcttgccatccaggagtcgaatttgtttccatctgacattagcgtattaaaaagattggagatcaacaagcaacaatgttcttgtagaaaggtaatcaaggtttagagcctgtgtgtcatgagactcctagcatttgaaaccgctaaggggttgaccaccattgtcccaagcacctgtttaagattctttcctatgataagggacctaaagtgattagcatactgataagattttcctagaataacctatttatttcagtattattctttcaaatcttaattaccatcttttcctttacccagggtcttctttctacctctacgacacatttaattacctatattccccaacctgtaccatattaaattttgaatggaagttttatagggtaatttattggaaggatggccttgagtgtcattatgttcaatgaatgccctattttgacaaagagatgactaaatgttattgaaatctttttaatccaccacgcttctgcttagatgtaaatgcaaatctgttctttacatttgtgattgaattgaacttgaaaagtaccgccatattgattccttctgcaaataaaatataattacatttccctaaactttctacactctcccaagagattggctggctttgtattgtagatttttggtgatcacagaggacaatgcattatcataagaccaataagatttatttttaccttggtaaagaattttaatttatttctagtttcattttcatttatatccatctcttctcaccctctgctctacaaaagtatatatgactatataaattgaaaaaaatatcaagtgcaaaattacagaaataaataattaggttattttagtggaggaaggtttgttgtgggtggaggaggagaggagtgagccaagaaaaacgagggaccatacgtgatcatatttttgcagctattttaaattgtttgtgtatatactttaaaatattataaaataaaattttaagtgcaatgcatatttggagccaatgatgagggataacttcagaaacgtagcatcatcatctagtgctttcatagtcctttcaacatttccagatagttttaatggcctgctcatggaggcaatgccctaattttaacatatctcttcacaactctgatttcttgcttcctaacattaaatgtcttcaaagcttctttcaccactaattccttatcaagaggataagccagtttattctttaagaaaaactagctacacaaaaccgtaagtcattccaacataaatccttcactatcctctctctatagatttggttttgattcctcctgctgaaattcaaccttctttcttcagctatccacacgtcttaccctctaacttccctcaggagtgtctattagctcccattacagtgaccacagtaatatagtaatcccctgctgttctcactctccacttccttacactgcgttttaagtctcttcatattctttatcaccttgtatcatgcatcggttttcttagttgtttattttatgttgccttcataaattccatgagagctcactgccgtatctttagaacatggaacagtgcttggaacataatgggcattccttaaatagctgtagaataaactttcaaaatcaacaataatgtatttgccaaatccattggcttctctgccattttatcttgttcaataccactgcgatattccccttcctttttttttttttttaaagtctgtaaccctttagcttctgtaatattcctagttttttattcctctcatgtgtcaaaatcatcagttgaggcttattgttttctctttctcactctgacctcacctttgtttacatctcatcttctggctttggctatcctgttttttatctctgttccaacctgtatttctagccctactacctggacatgacatgtggatatctccgtatgaccgcagtttccatatgactttgcaaattcatccctgctctcccctccaaagtcatccccacaattgacttcctgttccttccaacctattaaggttcaaacccacttttgctcctcctttgcaggctacacttttccttctcagtacctcttttttttccaagttcttagataaaagtcatagtaccttacgttgtaattgccactggtctggtctttctgcctgctttcctttccatttgtaatcacattatccattccaatccatttataatactgtgatcagccataaaaataacatttatcatatcgtttgtctccttaaaacctgtagtagatcccctctatttacaagatctggtataaaatcacccttcctgatattcaatgcctgttttaatataatctcaatattatgcgtcataaatccccctgtgttcttgcactttttatttcttatacatctcatcaaccatgtcttatcaactctcaaaacctgtattggttttcaggaaaactcataaattattcttttgtagaccttttgtttgtcatctttgaagatctctctctgaactacaatattttgtctgtataatcaatttggaaattcatcaggtattgaaatatgacatgtcttctattgtcttgaacattaattaaaactttatttgactttttatatgcttacatcttgtttcctcacggagtgttaacctactagaaagtaatagtttaatcttatatttattttaattcagatttagtagcatactttacacgtggtaggatgtgtaactgccttacaccttgcttacgtgagttattaatgttttcgtatatttaatctgaggatgtactagcaatgttaaaactgtaccgcatgaaattgagtaattgaactatttgttttaaatgtgttgcttaacttattgtaccattttctcataatcacagctcaagttaactttgtggttgtacgtattatttcttgtgaaatgccaacaaacttagagcaaggaaaataacaggtataatcatactataaaggcaaccttaacactagcatagtctcttagctcatatggtaactacaataatgtacagtgacaaagagaatattgtactttcttagcacacactttcctactactctactgttgtggataaaaacagacatactttaggagaaactatgttatttccaaataatgccttaaaggttactccaggaaaaggcatttacataaactatctaggaaaagaaccttttaaataatataaagagctcacccaaaaggactgaagtgtttagttgaaaaaaagtaaaaatgtcgaagactttgaaaaatagtttcttgcagtatattttcatcgcttccacttacgttatgaagacattaagcgctagtttatcaaaaactatttttgtacatgtcttctaatgacagaacaatgtcaacatgattttcatcattgagaatgcgtaaagaaaccctttgtacagttttttctatgaatgttcccctaagattaaagcaaatttccaacacgaattaggcactccgaaaggaggaggggagggaggggagcaagtgctgcaaaacttcctgttgggtactatgttcactatctgggtgatggaatcaacagaagcccaaacctcagcatcacgcagtatacccttgtaacaaaccaacacatgtacccctgagtctacattaaaaatagagattaaaaaaaggaaatcagtatataatctaataaatacctctcaagctttctcatttttaaaataaaattttagattattattttaggaataaaataggctcttcattgtatataagttcatttctgagttgcaaaaatcctctctttatgtttttttccccgtattagcatgtttttctcctgtttttccccactcaacttggctgccacaatcagaaagcacaaagacaattttttcttgcgcttgtaaatcaaaaccttagcatcagacaaaataactgctccaggtctgtcaaatagattcatttgagctttcttcatgcattgaatacggcagaatttctgacctgaagaaatctagccttttccaaatttgctttaagaacattttgcaataaatttaatataataaaaggaaaaaacacatcaggctagaatttggaaccgattgttattaaaaatctcaagtctatcaatttaacttcaacaaattacttaatttctgtgatggttaatttcatgtgtcaacttggctgggccgcagggtaccgagacatttggtcaaacattattctgggtgtgtttatgaggctgtttctggagagattcacatttgaatcagtagagggagcaaagccgattgttctcccttgtgtgggtgggtctgatccaatcaattgaggacctaagtccaatcgattgaagacctaatcaaaaagcctgattaaaaggaactcctgcctgatagctaaagctggaacacccatcttttcctgcctttgagcttgaattgaaaccttgggtcttcttgagtcttaagcctccagttctggggctggaacttaacgtcattggctttcttggttctcatgcctttggactcagacaggaactacatcattggctttcctgggtctccagcttgctgactgtaaatcttgggacttctccagattcgtaatgagccaatttattacaataagtctctccctctctggtttcgagagagagagagagagagacagagagagaaatgagagcacaagaacgtgagtgtgagagtgccctaatataatttctctaaatatcactggttactcttcaaagttataaaattggtataaaaggtgacctcaatttttcatggagttaatgtatgaaagtcacaattaaaaaggaagaattagttctggtgtcctgaaagttatttgaataaattaatatgctatggaggctttaaaatactatgaaaatttaatattgtattattcttagtgttgctatttttaaatagcactttttcttttcctttttttttttttttttttttttttttgagatggagtctcactctgttgcccaggctggagtgcagtggcatgatctcggctcactgcaagctccactgcccgggttcacgccattctcctgcctcagcctcccaagtagctgggactacaggcggccgccaccacgtccgggtaattttttgtatttttttagtagagacggagtttcaccgtgttagccaggttgttctcgatctcctgacctcatgatccacccaccttggcctcccaaagtgctgggattacaggcatgagccaccatgcccggcttaaatagcactttttcttgtgagtcactttttaaatatttgtgcaaaccttgttgccattctactcaagctaatatcctaaaccgaggacattataacatttcaggagtcaaaacttcagacacttaacatagtatcctcaggttcatccatgttgtcataaatgacaggattttattcttttatatgactcaataatatcccattgcatatatatgcaatattttctttattcatccattattaaacacttaagttgattctatatcttggctattgtgaataatgctgcaataaacatgggaatgcagatatctctatgacatactgattttatttgctttgtctctgtccccagtagtggaattgctgtatcgtatggtagttctatttttaagttttcgaggaacctccataccgtcctccataatggatgtactcatttacattcccaccaacagtgcataagggttcccttttctccatattcttgccaacactttttatcttttgtattttgataatagccattctaactggaatgagatgatatctcattgtggttttgatttgcattttcctgatagtgatgttgaacattttttcatatgttgtattaactaagccaaacacagaaagacaaatgcagcttgttctcattcatatgcacaatctaaaaacatcgatctcatagaagcagtaaatggacggtggtcaccaaagaatgggggaagtaggggaaaagcgagaatggggagaggattgtcaatgggtacaaagtcacgattagaaaggaagaattagttctggtgtcctgttgcatagtatggagactattgtcaacagtaaggtattgcgtatctcaaaacggctagaagagagggttttgaaggtttctaccccaaataaatggtaaatgtttgaggtgatatgctaattttcttgatttgatcaagtaaaggtcttaattgtttggcaattaagactcatgaatacaaataaaggtcttaattatttggcaaagcatgctgagttttgtaaacaattcagtagtgatttttgagaataggtcaatagcaaatattaattaaaatgtcttctatttatgacctacagctagatggtaaacagatagatgatagatagataactgatagataactaatagatgacagataaatgataaatagataaatatagataatcgagagagaatacctttcccttcacacacgtgcatataggcacactccatttctatcatagttaccaggattcagacattttgtctcactatttttctcaatgtgaacatgcatataggaatattatagtttttgttctgtgcccattttagttcgttttttaatatttcaggacaaaggcaatatggcggtttcactttgtttttcatttttgcttatactttttaaagctcagtgtagaaaagtttgaaaatacacaaaagtattaaattaagacagctgggcacagtggctcacgcctgtaatcccagcacttcgggaggccaaggtgggtggatcacgaggtcaagagatcgacaccatcctggccaacatggtgaatcccgtctctactaaaaatacaaaaattagctgagcatggtggtgtgtgcctgtagtcccagctactcgggaggctgaggcaggagaatcgcttgaacccgggaggcagaggttgcagtgagccgggatcacaccactgtattccagcctggtgacagagcgagactctgtctcagaaaaaaaacaaaacaaacaaacaaaaaagcacctatagtctttctcccataggttgccttcttaatgggttttacaccttttgatgttttcttgagttctgtcccattagcaagtagtattgtacaaaaaaaattttatcatcttttatttaatattttattgatgtttaataattagaattattttaaattttatatgtcattttaaaatgcaatacaatatagtaaactcccagatgtgattgtaaataattaattattctcccattattgggcattgggactgcttccacattttggtcactgcagtgaacatccttgtacatgaatctgtatgttgaagttgatttcattccacactccccttcattcaaggggctccaaccattctcgttttctttcagcttctttatatccaggcatataaagttccttcctgactcgggagcgtcatacatgctgttttctccatctggataagtagttaattctgttcttctttgtgcatctcccgtttcagtaacttcatctccaaagcctttccaggtcactttatctaaagttacaccataatcttgcaaatcctcaactattgagcattattagtctccgttatcattattctccattattctctgtgaaagcatcccgtgattttcttttgtccctattaccacaatatgtgtttattccgtgtatgtacatctttgtttgtttattgtttgtctatacctgcaatgaaatgcctaaggtcaggaactgtctgatgcaggatgcaatgcgctcaataaatatttactgaacaaattaattcatttgctcagtcttgcaggcaaatggtacttctgtatatttaaatatctaaaatgaaagcgttactcgttactgttggttgtcaatcaaaatttaaatgtcgatgtttaagcgtgaaagacctctgtcaagttaatctgtacttacccaaaggctattatgtagaagcgacataaatattttcctaaatgttgattttcatattttaagaagacaatgaatgtttcaaagcattttcttctacacagctatttattctggagagtggggcatatgtttcttaatattgttaaaattggcaaggggatactgttgctatatacaaagaacacctaatcatcatgcagacgttttgtttctggctctcagttatgaaaagcagagattttaaaaagttacctttatatgctaaattaggaatggcagaaggtaatattctaatgtttataagtggttcttctctgagtccttggtttctatgtttatgaattctctttttgaaagaaattatagttattattaccaggtctattcttttacattgtttctaattctatggtgatcttcaaaatagagtatcaattttaaatacttgggaatgaaattattcttcccatatcatttctttgtatggcatacattgtgatttgttgtcccatcattgtttcagtatgacctgttactgcaaaaacatattgagataaatcatcccacatactctcggccaggacagacatcacactgttgcagcaacacttcagatgagccccattcaaccttgtgtttttatagagaaggatgccacatgtttatattcatttctgaagattggctcatattatttattgaaacatactagtttaaaaatctgtccatttatataacacctggtctatctacataacttgaattacataaatataaaactaaacttcccctcttctccagtgtatagcttgcaagcaagtgcatgtgaaataaattaaagccttgtttgtgtttttttcatcatgtgagtacaagacttttcaataaaaatgaattacttttgaacatatttgtttggacaacaaacaagagaaaagatctatttgattgatagtggacagaattttcattaagttcaacagcagaaataccacaattgcatcattcaccttcgtgtatcaaaagaaaacagaaaattagatgtgatgaactctacacaaatgttcactatgcatactttacccattaaatacattatcaagaatcatgtcagcatgacattctaatatagcagctttacaaaaacatgtaatctaatctagggatgctgttgtcctctttaaatcagcttcaaacatattctgggttgatatttctcattcttttttgatccacattgtttattcacataatgattatatttaactgaagataacagcattatcaaagtgaaagacaaaatagatgtttaataggaaagtgagtatcgaatcatcttttttctaccaaaaacatctataattatgaagtatttggttaattattttcacaataatttaaaagtgtacaacttgccgatttttttgtactttctacttttcatgtctcgcatatatctctttaatatctaagtatttgagtcagaaaagagccagtaccgaataatgggaatctcactgaaatgtgataacaatctggggcctggtcctgggacctttatctgcaggacaacttggacaaatatttagacccccaattcctcgtctttaccctaggaataataacacatttttctgacctcatacttcacgtggatctcaaatggaacaatcatctgatagcactttatgaagtatatgaaagcaataaattatcacaataagataattgcaattattctttggcatagtattagtgatgtctttatctgtctgacaaaatcaacatttctgtatggtaactgcctttccttgttttaacagaagatcatgccagaaaagatgagtaggtagatacttaacttgttgttcctgaatctggaatgtattgcagatgtcccagactgatctttgttcttttttttccttacaaatttcttttcacattgacagtgtgatatttctttaaatgtgcaatacatagctaaccttatttgtttgtgtttactaattaaaatatctaaactgcttaaaggagaaaattcagttttaagttttattgatttatacccttcttcaatccacataggattagggtagtatgtaacaaaatttcaaactataaatgaaatattgagttttgtattaaggccaaggatgaggaaaaaaaaagtaagtatatatggaaaaagaatggtattgaatgggagttttgatggagcatgttgacatcatgataatacctattatctttatattctgaatgtcagaacaaaattagagcaattttcccttatttccctacaatacgtctgtcttaataattctaagctttcctgatttcagtagtaatctgtattttgcaaaaggcagcatgtttataagatatcaagtaaactaagtttatggaacttgtaacagcatttttaacaacatttctccctagatagttcatggtagacatgaatttattcaaaactagtatgtagaaaaataccattaacaaaagctctgaaattatattagaggagctgaataatgttacttgagaaagaataaaatgttatttatgatttttggtatcttttacccactatatatggccatatctctgaaaaactttagtaatatgtactaatgcaaatatggtagtaaattatgtctacaggtgctgataccatagtagataaagtatgataactttattttaaaatatcatatttaaataattaatatacagtactgggaaagactattttatctattctctcactcttgaataaaaaaatccagaaaaaaataccttgttttggtaagattatatcaatttatttcccaaatgggtagagggttatttttttctgatcataaacgtatgtctcttcattataaaaatccactaaaagtgatagaagaaaaccaaaagaataaatgtaaacaatgatgccattttccaaaaatcaccttcgacatttttctggatattgatacagtctaaatctcttttcggaagactccctcctgtgtaggttccccaactactctgcaatcttatttcctcttgttctgttcttgtagaaaggagacccattgtcaccatgtcaaataacacaaaatggtgcacgtataagatcattgtctctgtccattatttgccagaggacctcaaactttttcaggtggtgggcaactggatgtcatgctgctccttgtacaacagaacacaattcattatttatatggttatttcattttaagaaaatttaactttcattagctggaaaaaaaaagaagtggtttttaagttgtttagaaatgtgaaattcaattttcatactgcaaaagagattcaactgcaaacacaggcacacatgtctggtgtaagaacgagttgtcatacaaacccaaattagctgcctccacgttgtctttgttaacaagtgtttgtttgctccttgttccatcattcagaaatgctctttagcaggaattgatggaacacagtcgcagtgacctcttcctgtctttaaaaatcgagatgacatttgcccatctgcagtgttaacatagttcctcaaagaccactgacagtggggtaggactgtattgcgcaagttctctcatttccctagaatataattggtccagggccagagattttagctcatttagagcagcaaggtgctcttttaaaattccctcacctattttgggcttcatttcccttatacggttatgccttttccagtctgatgaacattctccttgacagagcagacaagcaaaaggagctgcacactgctgctttctgtgtcgtctctatccctaaccttctcccttctgccccaatcagtgaaccttcgtctttctggttcttcttcctccaaatggaagtaaaaaggccctgaatgttgtctttaccattatcacgagcctcaattcattccaagctcagcttttcctcactgtttatacagttctatattgttcttctaatatttgccctcagttctctgtccctcgtttcttcccatgttcatactctattagaatctgagcacctttgaggttgtccatacagtggcacacatctttgttttatactcactgggatgatttgccattatattgtcaaaattttattctaaagagcttttacaggctttcttgagccattttctcttgaaattcaagatcgttgaatctctacgctttttccttcttaatctaataaacatacacccccacatacacacgtgtgttcctgaaagacagatgccacttgactcgtcttatagattgtctaaattgatcattgtgtgtggggataaaagggtgaattgtataatatccctgatggttcacgaagtctgttcctgtataacctgattagtcttctgaactcttttaaattctgtctgcaaatgactgaggtttggcaatcagcctatttcagttagttgttttcttgcataagaagggtccatatgtactgtgtgaagtaagagagagaaagtacttagatttgctggatgccctgattgttagcatggctaaggtattgtgtaagtaaggagagcagttaaaaatgatattgtttttatttcttaattgaggtaaaattttatataagatgaaacagacttatttgggagaggaggaagagtttgttcttacataacatttcaacctgtcatatttagttgagaacttcaatctgtcaagatactttgtataatattcagattctgccatctaatatattttccacgctttcttactgggtgtgacagtaacttatactgtggcaggtgtataagttagtaaagatattaaatgctcaatctgttaacttttgtgaagtggtcccactgataaagtgacacctcaataaaataaaaatttccattacctcagaaagctttttcatgctaccttccagtcaattcccagccccaataggcacctattcttctgatttatatcaccatagattagttttgtctttttaaaaatttgtataaatgaaatcatacaaaatgtactattttgatcagcatactacttttgagattcatccatgtaagtgtatcagctgttcattcctttattgatgattaatattctattgtatagatataccacaatttatttatctattctccttttgatggacattcaggtggttttcagtttttggctgttatgaataagatgctgtggacatttgtgtacaagccatttgtgagcatatgttttcatttagtttgagtaactctgtagaagtggaatggctgggtgaaatgtttaaatttatgagatattgtcaaacagcacctaaacagttttctaaagtggttgtgccattttgcaatgccaccagtgatgatggagagttccagttactctacatctttgtcaatatttggtcttgtcagtcattttaatttttgctatcttacagaatatgtaggtatattgttgtggttttaacttatattcctctgattactagcactattaagcatcttttcatggatttattggacattcatatagattatgtgtgttgaagattattacctttatgattattgggtgaaaatagtatcattttgaggtcattcatataacttgaagactgggaatgacagacattttcctgttttgtttcttttctttttactttatctgaagagtctactagaatgcagtgttgctgcctgagcagcagggcattagctttgtaaaagctctgttccttggcaaccccaccactaatatgaagtgcagaacatttgaattgtctttgaccagcttcagcatcagcactattttttttttttgctagacccctagtaggtatttaaaagtacagaaatagaatttaatcatgctttttaccaaatgtgctatgctcttagagattctttcaacgtgcataaaaattctgcagtttcaccacataccagtaaaagaaactcagtcactcatttagccatttagtaaaaagaacaaattaactgatgagcatagtggagacctcaaaggtaaagaagacaatgtccctgaaataaagacaatcataaattttcaatcaaaataatgaaatttaggctgggcatggtggctcatgcctatgatcctagcactttggaaggctaaggtgggaggattgtttgaggccaggagttcaagaccagcctcagcaaaaaagtgagaccctgtctccacaaaaaaattttaaaaattatctgggtgtggtggtatgcaccggtggtctcagctactcaagaggctgaggtggaggatcaccagagctcaggggttggagactacagtgagctatgattgtaccactgcactcaaacttgcatgacagaatgagtccttgtctctaataataacaaaatttaatttttatagactgtgaaaaaccattatgtagatacagttcaagtacagtatgattttataggatagataacttttgcttgaaaatgtattcccaatttataggatagataacttttgcttgaaaatgtattcacaatagagttagtatttggggcacacctttatccatttaacaaacatgttttgagcactgccaggtagcaacacgttactaggcactagagtgagaaaagattacagttcctgctctcatggatctcatggtctagtcaactggaatgaaaggattacataagtagaggtaaagacacacatgatggaggatggagaatagtcaaaggtctggagaatgaccaggacgtcactgtgagttgtctaattgcactgaagcatggatgaagaattggaaagtcattgtaagaagcctaaaaaggtatctctcagggatgctatgaggttctgaatgttatgtacgctatttgggcttcaacaggcaggcactgagtattcagtataaatttttgagcagggaatccaccagaagaactatgcatctggaggattaatctggaaagattgtgtagaatgttatgcagtgaaagagtctgagatgaaacagttaggagggtgtattaataacataggtgaagtgtaatgaataaccaggctggaggaaaagcaataacgatggaatcaaccgggcaagaagtataacaattaggatcagtaaaatagaatttggattggaggaatgaaaaaaaaagggacaaaacaaagttgaactgctggtatccatactggaaaatacagatgtcattcaaataaataatgtaatgaatataagaaaccagttttaggagtgaagtggatgttggcttgaaaatatttcctttgaggtttcagtcaaatgaaaaggtcctgaaatgctacgtggtagcctaagaaggaagcgttcctagagagaaaaaaattagaaaagatttacatttgataatttaatcttttccttcatacaagctaaattgataagaaagtaaaacctatagttttcaccactcttttacaaatatccctaaccttttagatattcacatgaataattgagaaaaatctaacagatgacttgcttatgtcatttgtctgctttatccttaggttcctctggcttatatattgttcaataaaatacagatcattgatattgtacaatgtactgataatggggagtgaatccatgcttgtgcattcttttttttttttttttttgatttgcagagggcgtgcccagtcaacaagagaggcacaattgtttttatcatcacctcttctcatctaattccatgaaggagagtagtattaccatacaacagataatgagttggaaaacaagaaacctaacctcagaacttaaggcttggggaaaaataaaagagtaatttgtgtttaatgcctgtataacttggcaagagggacatataaggcttagtgatgcccaacatgtgcttagatgtggattgttagttgatgtcttgggggttctgtaatctaagctaaatgctcaaaatcaattaattgatgttagacacagagatctgctttgatccctctttatcgtatttctaggccttcccattctcaagagcctgagaaacgacagctttccttaataacttgttatttgtggtaggagatgaaactttgataaaaacacaattatttttaaatgtctctttttcactctaggctgttgtatgtatttcaaaaagttacttttgaccctttccagaatgagaaagcaatcaagaagattataatatcttgcttagttttctgctcaatttatcaacaaatatttcttaagcaattattaagctgagcagtgctcagcgctgtacttggtgatataggaaatggggaaaagactgtctttaaggcctttataatagtaattacctcaacttgtctgtttcttttccttaccatttcgccaaattcattgatctatcttgttctcaaagcaatcgccatagttatattgtaacacagcattttctagggtgtccccattaagttgagagtgttgacaagaaaatacaagcttatttatcattgtaaaacttgagacacctagtagttaccctaaattaaatatttgttggagtcagtcacactaaagagaacacttactgcattgaacaatttacctacattagacagcatttaaagactatgccacagcaaaggcccatggaattcttgtgaacacagaatagaagtgtattaaggaacaagcttaattctgttctcttaaagcacaacactttctcaaaacatattttgaaatcacctttgaccattttttttaactaataggtgggtgggagttagggtaggaaaacacaagcagcttcatcaaaacgatattctattttcttcaaatttgtggggaatcatacggcctctcaattttctacattatgctaattatgatattaatctctctgccagcaaatgaaaataatacatattagatgtagcaaatgtcaataatgacaaaattagtcatcatgcagatactcagggattcccaaaatatgtttggattatgattgctagctttgagtttgcccagaatcgtttcaataaaaataagggactcaaacacatttggagcaaaactcacatcataaattttagacatagctctgccaataatgctctcagttatattttcagtcctaatatttcctctgagttccagaccagtatcttcaactgtctgattgatactctctccttcatttctgtctccaatgcattaagtcctgtgtatttactttccaaatgccacttggttccatgcacttctctccatttctgccactgactcctcctcaatccaagcgaccatctttcctcactttaactaccatgatatctcctgcttggtctccttacttctattcccgggctcctccaatccattcatcctccagcagagaatgatgactagcaccttccacagtgtctggctaataggaggtatccaatcaataattgacttacagagtgaaaatataggcatggcaaataccagtagagaactacagggttttagaaccaatgacattagatacttccatcaaatatttacagtgtataatcaagttgacttgcacattgtcttatttttgaaaaacaattttgttggctttttctatatgcacacatacatattgtatcaccctctacccgccaaatggcttttgaagaagtatttatgtggctccaaattgataatacctctagagagaagagaaattagaaattttaaaatgacctatgcttcctttcgaatatcacgtcctgagacagtgttttttgagttacgtgcaatatgttccacgatgaaacatttaatgtgttcagaggcatgctagtaatcatgtagaaagaattttatgcctgaagtcacatgttctataaccaggatcacttaataagaaaacaagtacagctgtggacaagatgcctttttatcagggaaaggccaatttgttttctttgcaaatctaagtaaatggagagaaaaacacagcccttaaatgttttctatttgtcctgaagttctcatgaatgagttagaaggcgagaaggattaaataaatccttgaacgtagagagagctaacatttattttagcaaactaaaacctattcgctttgcaaagttctgttctgtactttgtaacaacagttttctttaaaacaagagccaccaattcaaatgcctttacagaatgattgaatgctttcatgccccacctaaaggcattcaaatcattaatcaaacaaagttctaacgccaaaacatgtctgggaccagatttaaaatgtagccctcagtttcagagggcaaaaacttaacatatttatattttcctcactttaggtaacactgtattgaatctctgcttgaaattgaggagcacgtgattttttctttttggcccagggcagcatttcttggaagagaaagaaaaacaacccaagatacccttacaaaacatgtagtacttaaagctctttatgatgaattaattttggtatacacattaatagcagtgataataacaaatctatatatatatatataattgatatgaataagataaatacatcaaaaggaaatttcattacaatttgatattaggtaaatgtcccattaaaataaattgctactgtacataattttccttcagttcattggcaggatgtttgctttggaaaataaacagtctatttctagttttagaaggaattctcattattcttttatagcaaccattatcaggagcagatgggaaattgtaccaagagcatatctactattatacctcacaggaaaaagagagtattaaatgaaatctaacaaggcctgctcctgactctagttcctgtaacaaatgaacacacacatttgtatggtttcagcatttgtattagtaaggtacaataaatgtttactgaaattgaaaaaaaaaaagataacaggagaaagaagaggctaaaaaggtgcattttatttctgatcgttcattgtaaagactgctcctttttaaaataatcaaattttattttatatacagagggtacatgtacaggcttgtcacaggggaatagcgcatgatgctgaggtttggggtacagatctcatcacccaaacagtgagcatagtacctacctgatgagtagtttttcaaccaatgcgcaccctccctccttcccacatctactagtccgcggtatctgttgttcgcatatttacgtccatatatgctctatgtttagctcccacttataagtgagaacatatagtgtttgtttttcctgttcctgcgttaatttgcttatgattatggcctccaactgcatccgtgcttccgcaaaggacatgatttcattctttttatgactatgtagtatttcatggtgtatatgtaccacattttctttatccaatctaccattgtttcacaactagatggattccatgtctttgctattgtgaatagcacaagacaggacctttttatttgactgagttccttgcaaattactaataaaagatctggaggtccttagttaaaagttgaatctgtagtgccgttcaaatttagagatgtattttctgttcaagagaagaaagccctcattcggtcatgcttaatattcagctgtaaagtccaaaacatatgagaatgacacaaatggaaacattttataaatacctatacaaaggaggggcacttagttcccctaggcctcttaaaagtcctctagaaagagggtacttttatgctaactattaaagatgagtaacgaatttgtcctatacaacttaacagtatcgtcaaggaagtagaaagttactcagttttactgggcattggagctaagcttgaaagtgaggaggagaagcggcaggagacggagccgagaaggcagtggggagaagaggaggatggtcctttccatgctccctgttgtactaacatgtttggatattatcttatacttcatatatggactggattcttgtccttctcattctgagctctccttgaccttgattcttacctcctataactttcattctttctttactcaaaaaaaggccatttatttcagccatttttcactgttttcttatccttcctagttgcttttctatactatttttccactcttttttttttctatactattttgcccttctctccattttcctaactgctagatttccccaattttagccatctttcaattgttctgactatcctcaggtgctcccacaaggttatcagaccttccaccaagacggaatccctcagtctatggacaggctaagttgaatgggtcctggtgctgtgcttagcatatgccttgagtatttgtgcatttattttgcttctttacaaaaatccatcatccgatagaagttgaaagaaacttgctgaagcacattaaaatctctgaaaacagtattggctatattttctaataattagcatgactggttaacttgctttatttatcattgaaaaaagtatcagaaactgtatatcaaactcctgaattcttggcactgacgaagagacacaatgagaatgaccttaggataaaaaaacaagataaagcaccatatttgtaggaaattgcaccataaaagtctgtttcacaactctcccaaatttcattttattacatcttttctcttgaccaatcagtaaactcggttaatgatttacctgtctcaaaataattcatgaacaaaattacaagtaaatctcagtattggattcttgaaacatctccttgttcaatgaagtttcctttttcttccctctatttccctgtatttatcttttcttccagttgcattttatctcttctgtttttttatcttgctccctagtttgtgattttttgccaattttttatttcctacataattcatccaatctgtcattgtacaatttcttataactgcttcttagcttattccttttcttcatttgtcacattctatttttcatctattgtgttttcatgcagttttggaaagttttacaaatagacttttaaaaaaatgtacgtaatgttttcatagaaaaggtagtggtttctttttcttatatccttccctgtataaaaataaaaatgtagcagttctttctttgcctatgtttcctctttccttcccccaatttgaccagacttgaaggacttagatatgtaacagtgttattttctataatttaggaacagcttttgacttaaaaagcagaagagaagttgaaaataatatagtaattctacatgtccttcctgcttcccaactctctgcacatgtttgtaacctcccctttcttttttagtgtatctctttcatatacctttgtccccagaaattctgattcagtagacttagaatggaattctgggcttttatattttgaaaagctccccacgggagttagatatgcacttcttattaagaatgaatgcttaatattggaatcaaaacacaataagctttctaactatgatgaataatccaacagatttaattatgattttctttttgtccagaaccaagactagatgttaattgccagagaaatagataagaatgcctatgacagcagtacattaatatgatatcaaagcttggaaattttattggtaatgaataattcagtacttaaaatatttagaagctatagaattaaaattaattaatgttgttcactgtgtgaataaagttgattgagattttacatttaattttgtaaacccagtgttatcttttccagctcagaaaacaccacatacaagctactactttctgttttgatcccttatttttctttcttatgctttatcactgaaaactctccttgagcaggccatgcactgtaaatatttctcctggttgcaaaaccttctcatacaaatgcagtagactgtgtaatgagctcttctttcacaaaattaaaaaaacctgaaagccctgatttgcgattctatacaaatgagatttagatctaacaattttaaattattgcttcactcttagctgttcaattctatctcttatttgggaaaccgaaataataaaaccattgctgattccacaattaggttgtaaaagtcaccgtagccatcagccatgaagcaaaagtgccaagatcaaaactacaaagcaaagaggctgagataaaaatgctgcagcattagtttatagcattataagcagcaataagaattccttgattgcttaacaaagactcaaaaggcatttactccattaccttacaactcaaagaggtattcctggaccagcagtattggcatttttttgaagtttgtaggaaatgcagaattttggtgcctccacggacctaatgcagcagaacttgcagtttagtaagatctccaggagatttgtatgcgcattaaagtctaggaagcaccgctatggtatacatctgatgtgtgcccatgcattttttaaaagtatgaagtaatagttgtaagtattggacactcttgaaggaacaaataagagccatggtctttactctctaaatacctccctgacatctatgttttaggcaaaatttttttcccatttcagtagtcactgatgcttgcacgatgcagtttattccaaaacaatggtgattctcatgtaatagttcatgttgccttaataatttacgttgcctcaagttctctgcccaggccccaatatacaccgagggctgtactcctcccctaacgcctgctctcatacagtggcatagagcccagttttatgctcttggtcacatcatggagattgcacaccacaggctttaacttctgccgtactctcactgcctctaaccctccatatgcctaagttctacgattctttaaattccaaattgacccagaagtctcctccgctcatccttttcactgagatcatccctcttctggcctaccatttgttgatcaccttgctttttttttatcctactgtatgtagtataacaaattatcacttgcaactgtgtcttattttttcaactagattatgtactgcctaagacctagaaaattgtgcttatttatttgaatctctaggaggatcagtaatgggtattaatactaatgactccatggtgatgatgagcctgaacttcctcccttcctttctttctacctctctcctttcctcccttcttttcttcctccattccttcctctcttcctccctccgcttcttccccacttcccttattcatagattcatgcgttcactcagcaaatgcttactgaaaccttccatgcatcagacattgtactaaacaataggaaactatcatgaataagacacaatatctgacctcaaagaatttatgatataaaagtaatggcataaaccgtgattacttttgcaccaacctaatatatagacacagtttgttatgactggtgtctctattactaagcaatgactgtcacatgcaacgctgatctgaacaggtggtaaagagtgagatgtaagcaatggagcaaagccaactagttacaaggaaatatcacatgtttactagagcacatctcatgggcattcaagagagtatggccaggacagcttgtgaatagttcagtaactgtgcatagttttatattcattgtgaggcaccgtgtcaccggtttgctgatttacagagtattttaattgctaactgtatgctaccaaaatttccagtattcgaaaataattttgcttgaatgtagaaaaagaaaaaagccaagaaatgtatgtgaaacgagagtctaagggagctttacctcagtctcagaaaacatgcattccttccttcatttaggaagcatgtactggggtctactgtcagcttgctattgtgtcaaggagtaggagaatacaaaaatattagagaatatgaatcacatctattaggagagttttctacatacgcacattattctgtcagtgacataaggatttgagtcattcagatttaaatacggtaggtacctcaagttctcagatattatttcattttctaaggttcgtatttagttaatatgttattttaatggccttacaaattctagattatcttttttaaaaagttaaatagaacgtaattgccatttttatttaatggtaaaaagcatttttgtttttgtgtgtacttggttgtaatattctccttttcaattgagctatttttctgatactttactcttaaaatttcattcaggaaaaaagtaaacaatatttaagcttgacaatcataaaaatgctctggtgactatagattattttaaaatttattactgtagcttagggatatcttgatgggatgctcctgaaagcaattaattctcagttttttgtggcttctaatgcaaaatacattgacgcagacagaatttgaaatgaattttcttctaatatagcaattaattttatttaaatatctctagagtttttttttaatactgtgactaacctatgtttgttctttttcacctctcgtatccacgatcactaagaaacccaaatactttgttcatgtttaaattttacaacatttcatagactattaaacatggaacatccttgtggggacaagaaatcgaatttgctcttgaaaaggtttccaactaattgatttgtaggacattataacatcctctagctgacaagcttacaaaaataaaaactggagctaaccgagagggtgcttttttccctgacacataaaaggtgtctttctgtcttgtatcctttggatatgggcatgtcagtttcatagggaaattttcacatggagcttttgtatttctttctttgccagtacaactgcatgtggtagcacactgtttaatcttttctcaaataaaaagacatggggcttcatttttgttttgcctttttggtatcttacaggaactccaggatggcattgggcagcggcaaactgttgtcagaacattgaatgcaactggggaagaaataattcagcaatcctcaaaaacagatgccagtattctacaggaaaaattgggaagcctgaatctgcggtggcaggaggtctgcaaacagctgtcagacagaaaaaagaggtagggcgacagatctaataggaatgaaaacattttagcagactttttaagctttctttagaagaatatttcatgagagattataagcagggtgaaaggcactaacattaaagaacctatcaaccattaatcaacagcagtaaagaaattttttatttctttttttcatatactaaaatatatacttgtggctagttagtggttttctgctattttaaacttgaagtttgctttaaaaatcacccatgattgcttaaaggtgaatatcttcaatatattttaacttcaacaagctgaatctcagttgtttttcaagaagattttagaaagcaattataaatgattgttttgtaggaaagacagatctttgcttagttttaaaaatagctatgaatatgactatgaagctaaaaaaagtgatagtgtcacttacctctagtttcaccacatttgtgaatacattcttgaaggggaacttgagccaaagaggtacaagtttaatggggaaaacaaaacctcaaaaaggttactgtcaaattcaatcatcatttaaatttcccttggaatgtattgaaggcacagaaagccaaatgcgtgctgctgcagttggaaagcctagagagtttataaatgggattttgtattatgcttccagttgttgatgttaatgtgtcttgtttcgtaaaggaagacttggcctttatttaccaaatgagactattgttatgaacaatgaaaacttcgttcttttgccaagctcttgcatcccacccatcatccacataataggtggattttaatattcaggaagctagaacaactcattgatgaatatctttcgttaagatgtattaaaaagaagattttggaattatgtcagttgtctttgcccacctcctctttccctctttattcatgttacattattcagaaagtagatacaattcatattttgtacaaaataaacacattagttgacctaaacacacacacacacacacacacacacacacacacacacacacacacacacacacacaccccttgccaaagttaaagaattatagcctcatcaaaagatattttgaataattaagtcttggttttgaaaatcttcttgattatagatagataaaataaagaactaaactttgtagttaaactacttccttaggtaagtcatatacttttttcccagattgaaattcttctcttaatcatacaagtattttattatttagataactgatgtgcttatactatgaacaggtataaacctgtataatgtcatttctgaactaggctcaatctaatccaaattaagatggtaagaaatgagaaaattaaaaaaattgaataccatactataaatatatatatacggagagaattcataaagtggattaaatcgactggaagattatttttctataatatataaagtattgtttcctattttaaatgtcttactcatatagtatttgaatagagtgtattaacattccctctgataactctaattcacctgaattttcaaaatcttgttatctgttattgggctctaaaggcacattataatttataaacaaagatgtagcaatatgcctgtttcaccaaataagctctaaaattttagatctttctaattttataagaaagtggtatatgctgactctgttgtgaaatagtatacaaattttaagttaattacagctagggatttggctgtaattaggaaaaaaattttcccatttaaacatgttgacctacattaaatattgcacttcagtgctttaaaaagtcaagttcagcttccttgagttttttttttaagctgagcttttaaagttgtctatttcacgctacattttaaaaataaatgttaacatatttaaatttccactgagaccacttttgtggcatacttcctcaggatttttatatcacttaaattttatgaaatgtaaaaatgtaataaaatataagtactggttctaccaatatactcatagctatttctaagcatccagtagcaaatcaagtaaaaattaataaaataatattttatgaataatatgttaacctaacaattaattatagaagggctgtaatcacgaacctattgctaatcaatagtgtactctcagtgcaacgcaagcagatgttagaagggaatagaagttatttattgcaccggtgaaaaatatataagatgcctattcaacttaacaacagtagtcttcgtttgtaatggactttaagtacagcggttagaaatatttaacattttttagtccagggacatcaatgaaagaaagtgtataaattcaagctagatgtctatatggagccctgtagttgcaaaactttaagtcttctgaaattttaagatattagaaataggaaaaaaaatctcaaaagttcaaataatagtggacatccaagaaggttagtctatgttggaagcaaatgaagtgtgaaatgtagtcagttagcgatgcagtttaagatagacaattcactacagcttcaattatgtaacagaagaactggatacatctataggcttaagcatgataataatgagtttaatgatggcgtagccaccaaaactgtctttgtacacgaaggaggtgcaaataaaaacctatcatcggctgtaaggggaagtcataggttgatacaaagcaagcctgtgtacaagtctttaagcaagcgtccatgaatagcaaggggcgccatgctcttcactggagaagaaaattacctatttgtctttactaacctctaactgaaattaagcattccttttcattttgaaagtaggcaaaaaaatcacagtagtacaatcagtacctatgaagtcacagatatgtacacatctcattacagttataataaatatatcaaaatatcatttatgcttatcactacttcaaaactgcagtacttattatatgtgctacagggtcttattgttgggctttaaaacattattctgaggaatgtcaggcttcaacagattgccaaagaagtccaaggcataaaaaaatgatcctagccagctgtctgtttatctgcccagaatctcatcctaatttactatggtttcagtcattttaatgtgcagtcactatcttcatacactccttttcttctggagtattctaggagaagacataccagtcgaggggttctggggagccaggccttcaagcaatggattgctgacaacataatgaagaggattttacttagaataatgtcagttgataaaagtttgaatgggagacggaagcaaggcagtgggaagtggaattcctaaattgaggaacctctgaatcataatccttagcaataataattaagatttcaaaacattataattctttcttcttttagacaagtctgatattgcttatcccatatcacagataaggcaattattctactaatatgcattaaggaatagtggttttaatttaagtgttaccttaatgaaaataattttgaattttttccttccccaagtctttttgtgaaaaatttcaaacatatagaaaaattgaaacaattgcaaaacatatgcccatttacactgttttcctccccctaaattcttagagtcaacaattgttaacattttgccatatatgctttttttctctcgctttctctaccctctttctgtatctctcatatatagggcatcacacacacacacacacacacacacacacactttttaacatttttgcaaataagttataaataccattatattttacccctaaataattcagcatgtgtcgctttgaaatacagacatgccatatataaccatgcctgtttattatgctctcctccaaattaaatataatactgcattattgttaatatccattccatattcatatttccttaatagttcaaaaatgtcttttatattttgcaggggagttagtaccaatatcttatcatggctcatgcattacatttggttattattatttttcatccttcttagtctaaaatagcccttccacatttttttcaccgatattgaaatttgaaaatgtccaggacgctagcctcaaaaaatgtctcatctttcaggatttgttttattttttttcccctgatgggatgatttaacttgttctgtagtctctgaatttctagtaaactggaagttaggtctaaataagacttcaagagatgcatgtcaaacatgtttggcgagaatacttcatatgagatgctgtgtattttgtattacgtcacatcaggaggtgcatcatatgaagtagtctcactaaatgctgcaaagttttattacttgcttcaggtggtgactgacagatcttgcattataatgtcacattttttcttcgcaattaataaatcatctaatggctttagtatccattgatgatccttccctaactcagttattacactggggcttgcaaaatggaggttttcctaatctgacatgatcttaacatttaccagctggctttcttctgtttgaaaaaaaaaaaaaaaaaaggtttttcctctatatttatgtcaaaatggactcataaatttttatttattcaatatattattatgaattacagttattattcttgcccagagcttcctgctcaattgtcccaggctcaccttggactttgcctatcccagatttagaattacccatttttttcaaggaactctggttacttttagaggtgaatagtacgtagaaacgtacatctgggtagtagccccttctcaatggaatgtgtgcacctttctggcaagcagtcccaaaggagataatattttcagattaccttggaaatgattcttgacaaatctctttcagaatacatggaagttaaaagtaagtctagacatgttaaaaagcccttcttgtgtgagacttcatgtacggtcattaagttactactcctttaaacctctctacttctgaattcttaaaccaaaatgtactagtatataatctatgctggtttgccatgcaaattaatggtgtaaataagataatgggaggcattcgtaaatgtacttaaaggaagaaattattgtttaaagaccttagctcattgtttgcatgcaaatacacgctgttgattagaaatgagccttatctaattcattaaagtaggcctggttggtcctcttcttgaaagtctccattagcaattcatattgctctatgcgcttccttgtaagacaactgttgtctcttaagttttctttaactttggcttcttacaaattcagaccccacccccaaccaaatagctttcaaccaaatagcttttcagcatcttatttcctacaaattaaaagcgaatattttaatgactcaaatggctctttacagtgtgtgcaatatgttaaatgtacccagtatatccgtgtgaaccagtgctacaagcctgctcacacattcacattttgcccccaggatctgtcccgtccgcttgctctgtactcaaacttcctttttttctcattgccagtttagaccttgactctccatccagcccagagtttggaaactgagtacccacaggctgaatcctgaatgcatgcagtatttttgcatagccactgtttttaaataattgacaacttttaaaaattgagagacctcattttttaaaaaaatatggatttctgtcttcttttgaaaatttagatctggctactaggcactcattactatattttctcttggcaccatcacctacaactgagtaacagatgtttcattttcttgctactcaaagtgtggtctctggtccagagcacagacatcacctgggagttgctaagaaatgcagaatctaataaataacagtcagcatttttaataagatttccaagtttccaagtgattcatgggcacattaaagtttgagaagcattgcctggggtaagcaagctttgtcctcagtttgcagcacctgtcccactttgctcatttatattaattgcttttccatagatatttgattttatagtacctcatgcagacctttgtatgatgatgacggttagggtggtgatggaagtgatggtgataacacttaatattgccatgcactgttccaagtgttttacgtagctcaatacttataacaactctatgaaatagttgctattctccttttaattttacaggagggcaacgaaggcacagactgataaaactctttgcccaagattgcacagccagcaagtatttgaaccaggatgcagtcccgcagtctgcctccggagtccttactctagatcagattttgcattatttatcccagttttgtccatcaggattctctggtatacacttgcaatttcttcctaccaaccttctccttacctttgatggccacacgtagtagcaaaagaattgaacatagaatctgttctgacctatctttccaaccctgtttttcataatttccactatttctgtttatgtctgaagctttgaatgacctgaagttttctgttcttcagcttttgcaaaaaaaaaaaaacaaagaacaaaaaacaagacaaaaaaaaaaaaaaaccgcttcctttggttgaattctctttccccttattttttttcccaaaatcttacacatcccttaagactcatcttaactgctattacctcaatgaattgtgacctgctcttctcaaacataagcagtttattctcttaaggttttcttgcccctttttataacactcatgtaatattgtatgtatatatcatgtatcatacctatttacatatgcttttcccccagcaagattaaaagcttcatgagggcagaggactctcttattgttatctctataacccacagtacttaccagaaagcctgatatattgtagatggccagtaagtactttcttaatttaaatcgtaagaattttattcacattcagattaaactgaagatttaaatctttacacttgacattattatatagattaaaaatagatctaaagagccagaccaatttttctgtttttatcatgttatcacatttccatggatacgtttgcaattctagaaattgaccttgatcccttctagtcttaaaaaaatggaaggagtttggttaataatattttaggtattcttcagaatttagtacatttaagagacaagtaacttcaatttatttagctagttatggcaaaaagcagctctttgattcaaacattttgtacatttgtttatcctactctcactgtatctcaactaataccttttaagtgaattaagcaggaattagccctgaaactgaatgttttagcctcatcctacatatagccacaagatgttttagatgcaatccatatcaccaaagagctatttttagattgatcagagagaatcatacagatattattattcacaggtgtcaatggaaaagctggtctcttcccatctgttctctgatgactcttgaaaagctttcaagggcattcataattcttcatcaaaagactatgaaaaatcagcttcatagttaattgttttatgtcatattttattttttcaacttggctagttctagtgaaacagactagctggcaccaaatatgttgttgcattggctggtaatgatgataccactgtgtggagatatacaagtgaatgtactttatttgtggccttccatgaactttatgtgcctgggaaagtaggagttagggagagtttgttagggaacgtgatctctgggatgggtcttaaaggatgagaagaggcaaatgaagagtaaatggacatgccagagagaaaaagtgacaggagcaaaatcactgaagcaagaaaaaatggcctacattgaaggactatacacagttcagtataaaaaggctctgttaagcaagcaccattgacttaccctaaactcttcattttctacatataaactgcccaattcccactccaaacctattgatggatattagtaacctattgatgtttttgaaaggtgttcaagtatcctttctggtaccatgtaccttggctcccaccatttgagagtatgttctccaagaggcaacagtctgtggttcctgacctggctatgcaagttattcttattattaaaattgtcctatttaattaaatatcatgaaaactaatgaaatagaaatgaaaagataagagaattgtggtttctatgaatactaaattgaatgctttggaagacttgataaaggtgattagaaaaaaaaaaaaggccagatgcggtggctcacacctataatcccagcactttgggaggccgagatgggtggatcacctgaggtcaggatttcgagaccagcctggccaacatggcgaaaccacatcgctactaagaaaatacaaaacttagccagacgtgggcctgtagtcccagctacatgggagtctgaggtgggagagttgctcgaacccgggaggcggaggttgcagtgagacaagatcatgccattgcactccagcctgggtgacagagtgaggaaaaaaaaaaaaaaaaaaaaaaccacggtgctgttgaattagatgtaggtaagacaactgtttaagattgggtatgagggatagaatccccaaaaaatggaggtattttgcattgagattattttcagcatctccaaatctgactgtaattcaaagaaaccaaactaaaagtcacagattatgaaatgtagaagtgttttatgcaaaaagtaatatgcttaacttcaacctgtgggcttttactccaggaaaagtctcggaccccataccaaatgagaagtaaatgagtgaccacttgtatattctaagaaaaataaaatgtttgaagatgtgtaaacacatttatataatccctccaattttacaatatttttccaaaaaccgcctatccacttaccctaatcaagtttgataaggggacttccttttatatgtaggaaggctgaaaaatgacgccatgacaaatgaaattgtcaagatggaccaggtcatggaagatttgaaatctcaaagaattttttccagggtagaatataaggatgttgggacgtttttatatgctttagatttgcatcctcatatgtccctttgacagttgagctcagagtgaaaaaaagagagtgaaactagtggcagggtgactcaagttagagacaatgagtaagcagaatagaactttaaaaacctgacagattcaagaaatacttgatgaaagtggaacaatttagtcgttaagtagatgggatgatgaggggaatgaagggacaattctaggatgatcccttttccaggttttttgcttgggggaactggctgcatggaaggctgttagtcaggataggaaatacaaaggagagtaactgaatggaaagaggaaagcaaatcagacatacagagctcaacttgggatataatagtcttaaggagctcttggaacattgaaaataaggtgatcagaaaacacgcatttgaataggtaagtctgaacatcaggaggaagacaagggctgaagacactgagccattttgctgtcaatgtagagatggtggcaatctccattgaactaactgcttctcaataaggtacctttctcaagtcattaatttgctaaccagtaaacaaaccagaattcccagagtacacattaaccattaagcactgctgtggaaaaggagttcaggtgtcaggaagccaacgtggcagatgagcactagtggtgacaaatgaaccaaagtgatatgggtgatctttatggggccacagagtaccactgtaaactatcacaaatcagaagggttgacaaacaaaatattggggataaatcagggaaaacctaccacaacatacaggaaaataagttcaaagatttcatcctacagattgcagataagaaatgagccctttttatttggggcaccctagggaaagagtagatgcccatatgtatatttaaagtatgaatacagcatttatttgaatatactgcaaatggtcaatacaagggtagctacagagcccataacatgaaaaggaaacacaaagaaatacatgccccagtcagactccttacttgggttgctgtaaattctctctccctttaaggttattgcatttaaagtctatctgttgattggacccaacagcagctgcaccaagactgtaccatttttaaaaaaaaaaaaaaaaaaaaaaaacaggccaaatggcattctgcatttattttccttgttgctgaagaaacttgaattgtctaccctcaaagcctgtcctttgagacacattttataattagaaacacttatttacaaagttctttttatgttagaatcacaaatcataacactccaaaaaaggaatacactatcctcaggtgagtgtcctacctttgtttacaaaagaaaacccaaagtcctaagagaaaaatgtgttgatcattttattgattccttaccttggtttaatatagttaatggatgtcttagatatgtataataagtctattatcatgttccctttaaaattctcttttgttttactaattatatgttgtcatagtttgaccattaatataagtctaaatttattataatgtgattttttctacaaaggttaatttgaattaaaatattttattttatctctctctactatgataaatgtttttaaaaatcgtttgtaaaatgaaagtactatatttgtgtaagctgccaatctaacaatttatcatttaccattatgatggtgaatgtataacaatccttatattcagcagaaagccttatctctcatttcagaggaatcttgccccggttaattattctgtctcttgaatgcacacaaacacaagcatatctttaccctttttctgctgcctcactatccctgatcaggtgaatgtttttagctcctagattacaatataaatatattcagacattcctttccaaatgcattcattccactgtacttgtcagagttcatagctgtgaataacagaacccagtttttgttgatagaagcggaaacggactttaggagaaagatacagacctgttcccattcctaaacaaagggatagaaaaccagctcaaaatgggcagaactcaaaaaagaggctcagctccaagaactatagtccaaatcataccctagattggatctcgaactcttggactcaagcgatccactcatcttagcctcccacagtgctgggattacaggcatgtgccacgacgtctggcccccatacactagatgtaaacgttgccatgcaccactctaccactgcagacactgggtgaagaatgtcattgctactggaaagaattctagatagtgccttataattctgtcactcattccagattcaaaaactgaacttcccccatcagattccatttgtatttggggattttgttcgacataatcagggcattcagattctgggcaaccaaagttaacaaatgtctcttacttcccctttcttgttattattcccatttgaatcttcttcatagttagtcactgttacttaaacacacattctctattatcacatttccctctcctctcttttgctgtttgcttttgatccaaaccactgctcagaaaccattattgccaataacaacaatgatttcttgtagttaaatccactggacatatcttagtcctattatccgtaggccatgtgccattaactgaacactttccgtattagcacttggtcctatcttatcttccaagtcactaatcttatctgaatttattcttacctctctatgtaattccttactatattgatgacactccttgctttacctgccccttacatcctgatgtttctctaggacatgttctgaaccctcccttcttctcattctatacggtttccctgattgttatccatagcaacaaatgtagctttcactgtatcaattagaataatatctagggagattaaaaaagaattatagtaactgaaacaaagtagaaatatattcatcttcttgtagaaggaatctgccagtaggtagtccgaggttggtatcattgctctatgatgttgaagatccagatcccttctgtctcacagatctgccatcctttggtgaggtccttacactcatggatcaagatgactatcagctctctatctatcacaactgcttttcaaaggctgcaaggtgtaggaagtggacaaaaaagggatacctctacccttttaaagggacttcatggaagatctacacaacactttagcttgtatgtcattggccagaatttattctcatgacaatgccaaactgcaatgggcattcaaaatgtagtggaatggatcatgggctaagcagctaagcagtctctaccaaagtcaccgatttcattttatggcctaagtctaatatttggcccaatatatagtttcagattagacctacatatgtagcttcaaatggaccatttcctcttctatgtctcaaagccatctcaaagtcagtatatccaaaactcaacatgttatattcctctcccaaaatctactgtgggtgatatcactatctattcatgtacccaaactataaatttggaagttacaagagctagtattaatgacactaagttttgtgcatttactctatgaacaggactttgataagagttttacaaatgtttcccacttaattgtcgcaatatctcagttatagagattttatacgtccatcatctcacctgactcttcgagatcataagcaaagcatggcagcattcttatgtccattttacaaattaccacattaagcacaagaaaaaacaagatatatgtccaaggctaaccaaagttatagaaggatcgagaactaaaagtcagtgatttagacccagatctgtgccttttcccttattgttacatatgaccatatctagctatgtgaacaaagcagctaatagtgacgacagggtagaacaaataagaaagtgaatattccccactacatttatgattatttgccagtttaacagcttcaagcctgtgtcttctcagatatgtgcttcctcttatgtctaaggaaaagtactatatttgatatgcttttatgaactttcttttttgagatggggttctggctctgtcactcaggctggaatgcagtggcatgatcacagttcactgcagccttgatctcccaggttcaagcgatcctccaacctcagcctcctgagtagctgggaccacagacacgggctactacacccagctatttcttttttttttttttttttttggtagaggcaggatttcactgtgttgcccacctggtctcaaactcctgaggtcaagtgatccacccacctcagcctcccaaagtgcggggattacaggcatgagccaatgtgattggcctgaattttttaaatttaattttattgaggtaaaatatacctctatataaataaaagtaaatatacctttaccatttttaagtatacagttcagtggtaataagtaaatttatgttatttttcccctttgtcccctctccctactcctatttctgatctctggtaaccaccaaggtagtgtctactttcatgagatccatgtttttagctcccacatgtgagtgacaacacataatatttgtctttctgtgcctggtttaccttacttaaaataattacctccagttctatccacgttgctgcaaatgacaggatttcaccctttgtatggctgaataatatcccatggtgcatatatatatatcacattttctttatccattcatcctataaattttaaatggtgtggaatttggagaatacttaaggaaaaatgacgattgtgtaaaaggaaagtatctacaaaagcaaggtttatctaccccataaagataacaagagaatctgtgaatgtggatacggtttctggagtgtttcagaggttgaaagattgtgaagaactggatgggtataaaaaaaagtgaggaggagaagaaatgaaagttctggaatgttctgtaaattgtagatgagttccctatattaattttaaaatgtaaattgagattataattattttttgatgatctatttttgctgggctgattctctgttggtgtaactctttaacgaatatgggtcacgtgggaccctggattttattagaattacatgtgcgaatcaaattctaactttatgagccaatataatgattgtttttttaatgattagagtctatccatgacaaaaacagcttgtttctcctactgacttatttggtgttttcttgctaattagcctttatactaggcagtagtaaatcagagtacttggacttcaggttggccattacataaacctggcaactaaatgctgggtaataatcacctatcttcccacctgtgtttattacctttggaagtatgtaacatggtatctttgcgtttatatttttaatttgttcttttttctcttgcaccagctacttaaattatctgagcttccttttactaatccaaaaataaagataatagtacatatttatagagatgttgtaagagtaagaggtaatgtaaataaattggctagctctatgcccagcacatgagtaggtgcttagaagttagtgtctgggtacatgacttctggggatgataaagtgagtagctcgataaatctccccaagaatcagtaaaatgggacacactggagaaaacatcttatgaccctggatatcaaccaacggcatatgctaaattaaaaagtgattatttataaaaagtactaaactttgtatatgaacaatatgaatttgtggtgtatttgcctgtattgcccccagtccccactcccagcttggtcaagcataatagttctatcaaggtagaacaagccatggaaataagcagcttcatcaccacagggactgattttatttgaagcagaagtttaaaactccatgtccagaagcattgtcagtaacggtggagacctaggcggcaaacaaaaaggcagaatagcaactcagctggcctaaagttgcagtcttgattggaacaagtaactgactggcagactggccagaaatttaatttaaccagcatatctgcaaaatgaggcagccgtaataggcctcagtaaggactccttgtgtctccttcatgaaaacttaaaatgtgcctgcatgttgaatataccctttaacacatataaagaacctttagcaaaacttggaagtcttactggcttgaggtatttaagatcaactgctggccaactattgactaatgcaaattaagctatgcttacctctaggaaactaggcatacagtttgtttctgttgtttgacagagaaagaatatcaacagccacacactgtggggaaacagattccacagatttcatctaggcaagttattaaaacttcaatttaaaaaacgctgggcataagaaggaacatcagaatttggggctcctttaatatgttatttaaaatgtcaaattttcaagaaaaatttacgatacgttcaactgtgacccattctcatggggaaaagcagtcaacaaaagttgtctctgaattggcccaggtattggcagatagagacttaaaggctcctactataaataccttcaaacaactgaagaaaagcatgtttaaataattaaatgaaagtatggtaacaataactacaaatagagaatctcaactaaaagatacacactatataaaagaaccaaatgaaaattctagaattggaaagtagaataaccaaaatttaaaaaaatcactaatggggctcaagagcagatagtaagacagaaaaaaaaaaaaatcagtaaatttgaaaatagataaataaaaattatccaatctgaatgtcagaggtaaaacagtataaaaaacgaacatgagtcatagctttgtgtcaaaacattgagcatatcaatgtagatgttacaagagttccagaaaaaaagagaatgttgttaaagaggcagaaaaattatttgaagaaataatggccaaacacttcacaaatacggttaagctcaacaaaccccaaatagaataaacacgaagagatcaataccctaaaacataagagtcaaactattgaaatagtttcatttgaaattattgaaagacaaatgggaaagtctttaaaacaaccagaaaaaaatgactcctcatgtacagggatcacatgattgatagttaatttctcatcataaacaatagaggccagaggtattgaaatgacatattcagagttctcagagaacacaaaattgccaaccaagaattccgcataaaacaaaactatccttcaaaaatataggtaaaataaatatattaccaagttgagaatgagaatatttcttgctagctgacctgacttacaagaaaaaactaaataaagtcattcaggctgaaaagaagtgatattcagtaactcgaacccaaatgaagagataaagaatcacagaactgataaatatgtagatacatataaaagactgtacaaatatagatatatgtttttcttcttttaacttctttaaaagacctaagattgcataaaaattataacattgtgttattgtgtttataagcaggaggagcaaaaatggagcttagcagagaaaaatatctaaattttactgtgttaaattagtttgaacttaagtaaattatgatcaattaagatgcatatgtaatctttagagcaagcactaagaaaataaatagttaaaaacaaaatttaaaattacacactaaaaataactaacaagacagtgcagtaaaggagaaacaggaacaaaaaagacatgaataagatgtgaaaaaatacaatatggcacatgtaattgcaactaaaagttgagaattcccattaaaaaaatctgaaatttgaaatgctctaaaatgtgaaactttctgaaggttgatataataccacaagtggaaaatttcacacctgacctgtaatgagtcacagtcaaaacacagccaaaactttgtttcatgcaaaaaattatttaagatactttataaaattacctccaggttatatgtataagatatctattaagatatatatatatacatatatatatatatacatatatatatatatacacatatatatatatatatatgtatatatatagtatgtgtgtttaaacttaggtcctatctccaagatattaggtatatgcaaatattacaaaatctaaagaaatccaaaatccaaaacacttccaatcccaagcattttggatatgggatactcaacctacatatcaatagttatagtaaatgggagtgaactaagcattccaattataggcagagatttcagacaggattatttaaaatatccaaccatagtttgtttaaaagagaaatgtattagagccaaaaccatataatttcaaagaaaaaagaggtactatgcaaattgtttacatataaaaaatgaagtgacaatactaatgtcagacaaaatagactttatgacaaaatatgtaacaagagaaaaagacatttttaattatataaggggtcaattaagcagaaaatataacaattataaacgtatataattaataggaaagtcccaaattctatgatgcagaaattgacagaattcaaaggagaactagacaattcaacaattattattggagacttcaaaccctactctcaatagctggcaggccaattagacagaaaaatagcaacaatatagaagaattcaccaacactatcaaccagcttgacctaactaacatttataggagacgccaccaaatgaaagcagaatacatattattttaaagtgcacatgaaattttctctgggatagattctatgctaggtcaaaaaacaaatctcaatacactcaacaggcttgaattcataaaaattatgttctcttaatatgtcagaattaaattggaattcaacagaaggaaatttggaagatatcaaaatattttgaaattcaacaacttctaaatccattggttaaaaactaaatcacataggaaattataaaatattttgaactgaataaaaataaaagcacaacatgtcaagatttataggatgtaactaaagcagtgcttacagggaaacttctagttttaaatacctattttagaaaagaataaaattcttaaatcattaactcaagctttcgccataagaaactagaaaaagaagaacacagtaagctcgaaggaagcataaggaaggaaataacgggggttagagcagaagtcaataaaatagaagaagaagaaagaaaaatcaatgaaaccatacattaatctttgaaaatattttttacatggagaagctttagctagactgaccaaaaaaaaaagaattaccaaaatcataaaggaaaaaggggtaattactaccaaccctacagaaattagaaagactagaatgtaataacatgaacaacattgtcaacaatttctgcaaaacatattaaatgaaaaaattcttagaaagacataaattaacaaaactgattcaagaaaaaaatagacatatgaatagacctaacacaaacacagaaactgaattagtaatttaaaattttccaacaaaaaaacccaggtccaggagaaagataggaatccgaggcatccacagtatagaagaagaaatgaaactctctttattcacagacaatacaatcctgtatgtagaaaaatctgatatccacaaaataactgctagatctgataagttcatgaagcttgcaagataatcaatatacaagaataaattacattcctgtgtactagcaataaaaaattgaaaatgatactaagaaaataatttcattctttgtagcataaaatagattaaatggtcataaatttgaaaatataagtactaaacctgtactctgaaaactgtaatacattgctgagagaaattaaaaatctaaataaatgggaccatattccatgttcatgaattggaagactcaatactgataaggtagtgattctccccaacttgttctatagatttaatgcaatctccatcgacatcttagcagatgttggcacaaattgaaaaattgcacaatcttggcacaaattgaaaaattgatcccacaatttatatatagcaattcaaatgtaccaaatagccaaaacaattgtgaaaaagaagaaaaaagttagaggactttgaaatcaggacattacctgatttcaaatcttgatgtaaatctgcaatgatgaagacagtgtggtactgtcataaggacaggcttatagatcacctgtaggtttaggaaacaaacctattcatatttttttcttaaatctactaactgcactcctaatgttgacaatggaagagactcgatagtccagcaataaactcttatatttatggtcaatcaatatatgacaaaggtgacaagataatccaatagaagaaaagcttattattgggtagcttattgttagtgtacagaaacagagctgattgttaatacaactcaacaggaaaaaggcaaataacttgatttttaaaatatttaaatatatatttctccaaagaagacatagaaatggccaacaggtatgtgaaaaggtgctcagcatcactagtcatcagggaaatgcaaatcaaaacctctgtgagatgaacactatcatctcacccctgttaggatggctactataaaaacaaaccaaaaacaagagataagaaatgttgttgaggatgtgaggaaatcggaacgctagtacaccataggtggtaatggaaaaatgatgcagctgctatagaacacagtagaaaggttcttgaaaaagttaaaaatagaactaccatatgatccagcaacctcactcctgggtatatatcccaaagaattaaaaccagaatctcaaaaagatatctgcactctcatcttctctgaagcattattcacagtagccaagatatcaatacagcatagctgtgcatggaagaatgcatggataaagaaaatgtggtgtattcatacagggaatattatttggccttaaaagggaaggacgtcctgccatatttgacaatatgtatgaacctggaaggcattatgctaagtgaaataagccagtcaccaaagggcaaatactgaatgattccatttatatgaggtgtctgagacagtcaaactcgtagaaccagagagtagaatgatagtaaccaggggctgggcgaagggggaactgggagttgctgttcaatgagtataaagtttcagttatataatgtaaataagttctaaagatctgctgtacaacatagtgcctgtactgtgcacttaaattattattaagaggatatgtcttaagtgttcctaccataagaagaagaagaagaaggagaaggagaaagtgaagaagaagaaagaaaaaatgaagggggcatgagcaaacttttggagttgatgcatatacttggttaccttgattatggggatggtttcatggttgtatgcttatatcccaattcatcacattgtatacagatgctcctcaccttaggatgggattgtgtcctgataaacccatcataaattgaaaatgttatgagtcaaaagtacattttcaattaatgatattttcaacttacagtgagtatatccagatataaccccatcctcagtccaggattatactaaatgtgtatcgcttttgcaccatggtgaacttcaaaattgtaagtcaaaccatcgtagtcagtcggggaagatctgtttgttaattatggacccatcgtgtacaccttaaatacttaataaagctgttaaatgaaaattaaaagttgactgggcacatggctcatgcctgtcatctcagtgctttgggaggccaaggcaagaggattgcttgaggccaggagttcaagaccagcttgggcacatagcaacattccatctctacataaaattaaaaatgtagccgactgtggtgatgcaagcctgtagtcctagatgctcgggaggctgagttgggagaatttcttgagcccaggagttggaggttacagtgagctataatcatgctaccacaccccaggagaccctgtctcaaaataaataaatagaagctttaaaaaatattggtatctcagtgttcctcattatccactgtatttaaggtttagctacttgtgcttgatgcttgacaaggtaatcttacttttctccctgatattggtatgatgcaaatttactatatatatgacacaaatttatatatgcaatattttctcgttaatggccttttattttactctcattttcattatgctttgccttttaagtcatatagcaaataaattatgtggcattttcttagcaactattaattcaggagaatgggaacagaattctctcatagattcagctggaaggtaatgatggtcagctcccagtggagaaaaaaaaaaaaactcccttcagttttcgtaaacatacagagaaattttctcctaagtgctatgtcagtctgctgtatgtcctattgatctgagaaccagaaaacacatattttagtttacactgccttgactctattgtacatggctaggtctgtttaaaaaagaaatccttgaagataccctttggattctagtattttaaaacggatgcttagctaagtgaagtggtctacttcaaggatcaaaaccaatcttgagtaatctgttaggtagactccctaagttcatctgtaccttgtaccaaatttttaatgaatttagtaattgacatggatgtaaaataaataatacactaataaagttcatgcagaatcaaattttaatgcccagaggtaatgtagaagatattacctgtccatttctctggacttagctcctgcaactctccatttttctctctaaactttagccacactgaattcctagtttcaattcctctgactcgctaagtatttcttctaccttgataaaagctaattcctttgtcttgtaccatctgtattccggctgatattgacatagttttcagggctcaatttcaatgttacttactcagagggactcactgttacaaccaccacagccttttcaatctaagtaagatccactgctcttcttagaaacaggttatattccaaatgactgtaagtgcttttgttcttagaacatatgtctccattcaaaagaccgatagatattcagttaagccctttgagaaaattataaatgttgaggaccttgattattattgttattattgcttcttttctatgttttcccaggactctcaacaaatttgctttgcttttgtactcatggcacataatgagattaataatgtttagaaaacatttcaaaaatacacacagaggagacacatcttagtctaaagttagacatgataccaaaaactataataactatagctgaccagtgaccccatttattcatggaaagtaaaatttgatgcatatttgcctttaggagcaacatacctatgaaagttctgaaagtgaaagtttgtaaaaaaggagtactctcctaacaatcttaatttttttctatatatatgtatggtttgcattaaactcttttgtatgattagtggtttaatgttgatgtcacccatgacaccataagctacgtgtatggactggctctgttttgttcactcctgaatatccagcaaaaatagtatagtgcctggcccttggtagatgtgtaataaatgtttggtgaatgcatagctacacttcaatgcttatcgcattttaatcccagctactcggaggctgaggcaggagaatcgtttgaacccaggaggtggaggttgctgtgagccaagatcgcgccactgcaccccagcctgggtgacagagcgagactccatctcaaaaaataaaaacaataaaaaaaaggagacccattcatgtatctgtatcactgactagcctgtcaacattttgttaactacctcatcaagtagcaaaatcagtacctggtatgtggtagatgctcaaatatttgttgataaaatacagtaagttaatgacaggcgagcttgcctcagtgaaatataatctgtaagtgagcagtgtgtatatcatttgaaggtgccctacttagcctagcatatcacagagattcccagtaaatatttaggcagttcattaactctaaaagttgaccctcatagtcattggcctacattattcacctccctctgtctctaataaattcattggcaaatttctgaactccaactggaatgtttgtggtggatttcttcatacctaatggattatttcaattttcattttacattgtattatttacttgtctgaggtctttataatgacaaactcggcatgcatgataagctgtcattacttatgccagttgacaaggacatattatttttctacaaaaaaaattatcttggccaggcgcggtgcctcacgcctgtaatcccagcactctgggaggccgaggcgggcggatcacgaggtcaagagatcgagaccatcctggtgaacatggtgaaaccctgtctctgttaaaaatacaaaaaaaaaaaaaaaaaagcagaacaaaacaaaacaaacaaacaggagtggtggcgggcgcctgtagtcccagctactcgggaggctgaagcagaagaattgctcgaacccgggaggcagaggttgcagtgagccgagatcgcaccactgcactccagccgggcgacagagtgagactccgtctcaaaaaaaaaaaaaaaagtggtaattgttcaaaatatttacttattaattcattttaaaattgcatgttgaaataaaaaataaatgtttagtttttaaactatctcttctacaacagaaacaatatagtgagaagagtgatcttgttttacatttttgcaaatctctttaaaagttagcttaagagaaggcagctggttcttatatctgtttctgcattgaatgtgctgtcatatctcgcatcatgtagcctctgaaaaactcataatagaatgagagaggaaaaagtcaaataacatcttagtattattacgaaaataatttggacctcacagaaccactgcatgggtctcagggactcccaggggtccccagaccacatttaaggaaatactgtttcagggaatataactatttttgtacctcctgtggctatattcttttaaagaatagtaacctctgtttctgaggaacttagctgcaattatgtgcagagtttaaataagtgaaacggaaataccctttgcctttctgctcgagtatgaaagtgatgatcaaaatgttcccttttctctctctctctctctctctctctctctctctctctctctctctctctcactctctggggaacttcgggtttccgtctctatataatgtattcatattccactggaaacatacatagtttgagaaaacagatgacattttttctgggggtggaaagaattactaccacgaggaattcaaaatacagacacagtaataaaaatcaccataaagcccagaggggaaaaaaattgagtaacaaaataggaggtgaaattataaaactgagtaacaaaaaagaggtgaaattataaaataaatgataaagttggttgtgggttaggaagaaagagaaatataaagaaactggcataatgtaaaagccaagacaagaaaagtgaggcagaggcataggtcttttgactattttccatgtttgattctaaggtaagtagatatagtttctcatagttggaaatgttcgtgaatttaaacagaattaatgtttataatcagatgcaatgtctagtttttctatttgtcctgtgaaataataattgtgtaaagtgctcatgattgtttcaaggggtgaggagtagttctaattatcatagatattttcatgacttcgcataccactggtttatagagattatacagattttcttatatcagaactctcgtatctttaattccctagtagatgtctaagaaggagatttatcacatagcagatggtggtaaacttgagtaaagtgccagatactaaatgcctttggctttgtgggccattcaatctttgctgcaactactcaactctgctattgtagcatgaaagtaaccatagacaatatgtaaatgaatgagtgtagctctgttccagtaaaactttatttacaaaaacaggtggtgagcacaacttggttcatgagccatagtttacaaacacttgctgtatagctttccctggttgaatttcgttaattttatacagaacctgcctcccatacacacacactttgttcttcatggaaaatctccccagactactatgaaataatgttattacttggagatatacaattaagatgatgtcattaggagattattaatataggaactaagcaaatactatatgctaagtactgaggatagggtgcgatcacaatagatagaaaatctgcaatagtttgatgaacatgggaaattacagtatttcctgtgatggaaacattatgaggggctgtgggactacataacaggacctgtgacctatacctgggttggggatgtctaattaatcaaggaaagctttgtagaggaagtgatgtctaacctgagattggaaaggtcaacctggagctacctagatgaagatgtatggaaggacatcccaggcagagggaacattgtatgatgaatcctgatatggatatagtgctggattttaaggaagagtaagttgttccatgaactatacagtgcaaagaaagatgaagaaatagaagtagagaccagatcacaaagggctttttgaccatgttagagaagttatattttatcccattggcactaggatgttgttgagtatatgaggacatgatcagcaacatattttagaaagatctcttattctgaagtgtaaagagtggataagaaggagacaaggtaggaggcacgagctaattagaaagcagtctcagagaggctgttagaaatcagaacagaatggctattattaaaaagtcaaaaaacaacagatgatggtgaggcttcagagaaaagggaatgcttatacactgtttatgggaatgtaaatgagtttaggcactgtggagagcagtttgaaaatttctcaaagaacttaaaagagagctgccattcaacccagcaatctcattacttggtatatatttaaaagaacacgaatctttctaccaaagagacacatgtactcacatgttcgtcgcagcactatacagtaacaaagacatggaatcaacctaggtgcccaccagtggtggattgaatgaaataaacgtggtatacatgcaccatggaatactacacagtcataaaaagcatacagtcacgccttttgtaggaacatggatgcagctggaggtcattatcctaagtgaattaatgcaggaacagaaaaccgaagatagttagaagctaaacattgggtactcattataaaggtgaaaacaatagacattggggactactagaagggggaggaaggagaggggcaagggttgaaaaactacctatcgggtactatgctcactacctgtgtgtggtgggatcatttttaccctaaaccttggcatcacacaacatactcaggtaacaaacctgtacgtatactacctggatcaaaaataaaagttgaaatcagaatgagaaggagcgaaggagacagcgacaggaggatggagagaagtgggcagattcaagagagatttctcaagtggacttatgaggacatgcttattgatacgctctgggagtgagggagagagaagaatcaaggatgacttctacactttcagcttaaaaaaccgggagctggtggagtcatccattgaacttgacagaggagcacgtttaggcaggaagatgatggtgtttgaatgtctgcgaagggaaaaactgaactgggattcaaatcagaaaaaacggtttgaagtcataccctcttaattgcattttctatcggatggtaatggctttgtgacaggctttactgataggtgatgtaactctgcctctgacagatgaagatccaaagcatcctcagattttcccgaagcctgtttcagcaactgtgtagacagcacacacaaaaatctggggggaagtcctagggctcagttagttgattggatctattaaagtagcattggagaacacagttcagtctgagatttcccaaacatattgctctataatttatttttacccagaaactgaattcgatgtgggatagggattataaaagccttcagattccagatagaatctctgaatagaaggcttttgggccacatctagtaatctcctttcctcactccatttctgaacttcttgttcacttcttcgctgtttttaggacgttcttactacactcctgcctcaaggcctttgtacttgttttctctgcttagggcgttctttcccgcaatatttgcatggcctcctccctcgcttctttatttctatattacctatctttattaaagctgctataaaaaaaaaaaagcccacacctcagtggcttaacataatagaaactttccgttcatgcaaactttacaaaaattttctggtcaacaagtagatttcctccaaatggtggatcaggggggcccagggcacttcgcttttgtggctctgatgtctttaacatacggatttcaaaatcactgtgctcttgtacataagaatgaaaaagaacaaggaatattacatatgtggtggtggttattggaggtggggttatgagccaggcttcatattcatgagcatcacttttgctcacactccattggctcgaactcagtcatgtagccaaactaatggcaagggagactgggaaatgacagctagctgcacaattaagagaaatgagtagacttgtctaatgagcagctagccagtccctaccacgaggactttgctcaaatgtctccttctccatggaaccttctatgatcaccctttataaaatcacaactgctccccatcttcccctcaatatttccatcccttttccatgcttcatttttttcctctgtaacacttactgtatcacaatctatagattttatttctttatcttgtttactgtctgcctccccttcctcccaatcggatgtaaggtccatgaggcagggattgctgccgatattcacggccatatcaatggacactagtagaccctcaataaatggctgttgcattgtgattacatatatgcttcacctagaagtagtctcatctggtggcacatttactcatagattgacattaattctctattgttttttccccagcaaaatttgtcaaggtagtttgtcagtagggagaaataaagttgtcaggtggctcatcaaaagttcaattttgagtactcctcctgtgtactcataatgttttataaatacttttatctatgtaagcacgtgggcttagacacaattctaggattaaaacagaaagctctgtatccatattttcccttttttgtacctccttttatgttctctaccattttttttgagtgctgttagtgaagcactaggctaaatcttgggtttctgcaaaaaaaactttaatcctcacaacactctaaaatgtttattgttctaattttaagacgaggaaactgagggctaaagagattaaggaactcgcccgtgttcacgtactcagctgataactggcagcatttagatttggacttactttccatacagatattcgcattgctaaccttcaggtttttccctcatcgttttccacatctactcaaaagttgctaatcatttccttaatagtgaggcataaatgactgagaaatcttgatatattatccccctcaggagcacttcattccgacaagacacaaactttagggaaaatgaacaaatgtctacttgtacaactcaagcaccaaccaggtatggtagacatgttggcttaaaaataaagttgatgcttgggttctgattctgataatgacctacggagggtatggcctgaggaggttactaggtgtgtgtagaaatcaatgttttgttttggttttccctcgggaagggtcaacttatacttgaatccttctgaagtttctcaaattacaagatggtcatttattttacttcaatcaaaacaacaaagtactgtccgggaaagatgtattgccttgacttattctcaatttatgcttattttggaggcttgtagaagtaaacctgatagaggagggcaaaaacacacacacacagacacacacacactgggagaaaataaatttaacacagtttagggattgactttggttgtatgacatcacaattgcaagagttggatgccattgtaaacaagctatggaaagaatactgttaaaagtaactcattaagtggttacatggtgtagctcatggacatatggcacagaaaaaagataaagctgtctttacataacataaaactgtattctgttatgtaaatgtgtgcttgtggcttgcagtaaaattcctagtgaaacattacctctagattcagcagtactatacctcaggccacatggatgtaagtaaagatgatgccctctggaaaactgagttaggcaacaacaagtgcatccatgaggatgcaaatttcaatgttgaaggtgcctgtgaagaatttgaacaaaattgttgcatgaaatatgaatgaagaagtgtgatctaatgacataatattttgtactatataattttaaagtagtacacacaatcaaattaatgaattaaacattatatgtaaacaggtgatcattgtatctccattttctaaagtttctatgttaaaggtgatcaaaaaacttggagagagggacttctcatttggaaaatgggatagtcacctttgggtatgtgatgtatcaatctctagaacttcagtttcttcattgaaagcatataaaaggcaatccaaaggatgtatggaatattaaaagattccactgtgaaactatctagcactttacctgaaacacttgttagatcccctcaccaaaatcatgccatgtgatttggcagtctattcctcttagcgtaagagtagcccgacagaaaatgttcattaagagttaatgttaaattcattgaatttagcaacacatgagtagcgcttcctttctgattatgcaaatctctcaccatcgtaatacgtgcttcctttaatttcattgggaacatttgtaatgtaaatggtaacagagccaatatttcaaacagaagccattctttctaaaaaaagctaaatgtctaaatgtattgaaatgcttctaaaagtaaaatatttagcacttatttgcagatgggtaatgttaaatatctcactcattattattactaccacttgtctgaataaatcctcccataagcattaagcaagtaggtaaacaaagaaataacacttcatgtgatgaatgccaatatgaagcacgtttaaactgttctgtcaagagacaagcctggaaatgctaactgtgtttctttgcttttctgcaatcatctgaatacataaattcaaattgcagcttttaaaacttcaaatcgaggcttttgaaatttcagaaaacacatgcgcttggaaaagcagattataacaaggtcccaacgggattttgtcaccatcttttttatatttcaaagtataaaaaaaatctagataagaaatgactaccaaatgttttcatatttaaaagatgctgtttttttaaaaaattaaatcactggaaaaaaagttttccacaaatatcgtgtaaaaagaaagacagcaaaaagcttagccaaagcttttactgtttaagtgatgatttattctgagagttcttaagagttttctaaattagtatatggttaatatccataaaatcatatgcaagatgctgtctttcaaattgatgctgaaggttaattataaaatgtacttaattatttatagtgtcccattgagtcccagatactctgtgtccaagaacactgtaaatacagaaagtttagcagaattatattggaaaggcagtaattcttcacaaattaacttattgatataatgcaatcccatttaaaaattttcagcgagaattgttttataatttgactgaatgatacattacataagttagaataactaaagtgggagagcgggttaacctaccagaaattaaacatattttaaagctgcaataattgacatagtgcattactgtcacaaaaatctacagtagatcaacaagcagaaacttaaaatatcatgaagaaagcaccataaatcaattcagaagagatggtgctgggggaaaaaatatcagtttctgaaaaactcttcaaggttagaaacaacactatataaatttaagatggattaaatatttggttgttcttttttaacaaatgaaagagtaaaggatcaagaataaatgagaatatctgaacaatggtaaaatggccacaattttaaggatactatcaatgaacataatatcaaagaaataaactgttaaattttatttagaaaaaactactaaaaggcaaaaaggaagctggaaacgtagtctcaattaatctatgtttcagataatgtgaaaagagctcttaaaaataggaaaacacaggaaaaatgggcaacagacattgccgataattgacagtggaaactaaataaatgacaaacatgtacacacatacaacattttcaactttcctattagtagaatacttaaaatatctatggcaagctttttatttgttttattggtatatcaattataatgctcaatagtggcaaaagtgtagtgagacaagtattttgtaactgttggtgggagtttacgagtgttctgagtaccaaccttgacagaaattcaacaatgtgtatctaaatccttaggattcccattgttaacttttcattctcattccagcagatacatgattcaaaatgtataaataaatgtgtttattgtagggttattcattataataaaaaatgaaagcaaacaaaattcctaataacacaataatggtgaaatatagggtacccctatatatcttattactaggatcttaaaaaatcaagtttttaaagcgtaattaatgacctacagagacacatagtagaataataaatgaagaaaataagcatacaatatagggtttgaacccagtaatacatataaatctcaactatgatgaataagcacaacatctctcctctgtactggatattcttgatagaaaaaaatatgctagtaaataatttgagacatatttgaaaagaggggagtgtttgatttagaattttctaaacttgagggttattattatttttttggtttgatattactttttcctgctccttaaatttttgtttgtttggggggtttggggttttcttttccttaaacgtgtctgcttctagatgaaagttgaaaatgtttaaaagccttgccaatgtgtctaggtttttcaaatgtaatcagattttagcaagattttacttaactaaaagtattcagaacactgtgcaaaatcatctggagtcaaatagtaatggaggcaatgatttgcagagtagaaacagagagagagaaaaagatgagatagaccctcaaaatctagacccaaggaattaaatctgcttggaacatttaaacaaataaaggatgcctgtactatactagacgttttcttcttccacaattgattctaaggtcagaatctgaggggaaatggtgctgttccacattctaaaacaaactgccagcaatcgagaccagccacttccccatagggtttactctaaagcaacagggattattatctctattccaagcaatttccaatctcctctgtactccgtgtcccaggcaagattaaaaagactcaggtaggaaggggtagtaagctttgtggggagtgcagtttgtggtaagggacagttccttctctttcatctctctgagtcagaagtagagacttcgagagaatcactgagagtaagtatgtagactccaagaaggaaaaagcatcctctcacttcaatgaatgtttggaatctgcagacctccttcccaggtctgtgtagcttttggagaggccagaagagcaccgtaggcattcctttggctttccatggccaagcacatagagtagaagaagaggaggaaccgtaaggttaaccatacataagaaatcaacaaaaggctttgaaattgacttttcctatttttcaatttaaataagagagaattgtcaatgattaaaattcataaaacgaagaaagaatggactcagaaaatagcaaacatgaaatgttaattattagttcaaaagttagtttaccgtgttttctctgccaactgattgctaatgactaaagtccttatttccagctttcctctctccccgagctccagatctcttgatttattaaactagtagtttccccaaaatatatgagacaacaaaatatactctcagctgaagtaaatagcattcatcttcccagtcagataaggcagaagtacttctagatcagatgttatattcgggataggttaaaaacagaccctgctcccagtgtcccaggaatgaacagtggatgtgcttatttctcattgcatgcgtgtatcaaaatatctcacgtaccctacaagtacatacacttactatgtccctacaaaaattaaaaacaataaatcataaacatttgtaaaaataagcgaataaatgtataaatgaatttaaaagagaatagacagaggggagaatgtaactttacgtgtcccagaacagactttgaacaggctcttatcatataggaaaactgaatgaatatatgcaagcataagtccaataaccagattctgatttacagaatgatcgcaactgtagttctctcaaggccctgtctttgaacaggctgtgtcttattcctgcaacatgctgatctatcttcatgcttcaagactcagatcattatcttctctgggatgtctcccaagcactgccccagaaataacttctcctcctataatacttaatcataatccttggcttacatgcttgtttcttctcattgactatgaaatcctcaagacaaggtatataacgtatatatctttaatcctaatgcccaattgagctcttagaaggtagtaagctcccaatacacatttgttaatttgaagcaaaaaaaaaaaaatagctaatcattcaaaaaactgaattatcacaaatgtccatctaaagtactatatttacacaattaaatgctatacagccaggttaatgaacagactaaaattatatgcaacatggattatcgtaaacataattttgaatgaaaaaggcgagacacaaaggagtataaagccatacaattccattttcataatattcagtaccggcaaaataatcaaagttgacagggtactggttatacttggaggcagtgactgcaaagggataagaggagatttctgagattctgataatattctatttccttctctggttgtacagtgtgttcaatttttaaaacactattgggctatacagttaaattgtgcagtgtcctgtacgtatattacacttcagttaaaagcttccatggaagctacacatagttcccaaaagacaacaaaacaaaaaattttcaattattttaagcacaaacaattttgttcagctgtcttacaatcgaatatgtaagaataaatttatggctaattagcatagagttatatgcattttcataattaaaacttccacgagtacaacatatgttaagtattttaaatcagtttttctctttcctcaaataaggttgtgagtcataattcggaaaacagtttagcatgtaataatttagtgttttattttaaaccaagctgaagccacataaagcagaactgctcaactgagccctatccaaatccttgacccacagaataagaagcagataaaatggctgctacttaaacaaaacaaaaaccttgtttatatttttgtcctctcattttccataagtatactttaattaaacattttaaaacttgtaactttaggttatatacttactttagttggttctcaaccagggacaattttgtccccacccccaaccccccagcatatttggcagtgccttgaaacatatttggttgtcacagctcaggggcgaggtgttactactggtatccagtgtgttcaacaggccagggatactgctaaataccctacaatgcagaggatagctgctcacagcaaagaattttccaaacctaaatgttagtaatgctaaagttgagaaaccttgctcagatataatgacataatgttgttagaatttttattttattcattttaatgtatgtatgtatgtatgtatgtacgtacgtatgtatgtatgtatttgagatggagtctttctctgttgcccggggtggagtgcagtggcacgatctcggcttactgcagcctctgccttccacgttcaagtgattctcctgcctcagcctccctagtagctgggattacaggcgcctgccaccaaacctggcaaatttttgtatttttagtgtagacggggtttcaccatatttgccaggctggtcgcaaactcctgacctcaagtgatccgcccacatcggcctccctaagcgctagggttacaggcatgagccactgcgcctggccaggaatttttgaatcagaatttttcttgttcgattttaatctcttatcatttagagattcttgaaatattgaaattactttgttcaaagtgaatgaattttcttaaattatgtatggttaacatcttttaaattgcttatttttaaattgccatgtttgtgtcccagtttgcattaacaaatagtttgagaactatgttggaaaaaaaaataacaattttattcttctttctccaggctagaagaacaaaagaatatcttgtcagaatttcaaagagatttaaatgaatttgttttatggttggaggaagcagataacattgctagtatcccacttgaacctggaaaagagcagcaactaaaagaaaagcttgagcaagtcaaggtaattttattttctcaaatcccccagggcctgcttgcataaagaagtatatgaatctattttttaattcaatcattggttttctgcccattaggttattcatagttccttgctaaagtgtttttctcacaactttatttcttcttaaccctgcagttctgaaccagtgcacataagaacatatgtatatatgtgtgtgtgtgtatttatatatacacacacacatattgcatctatacatctacacatatagatgtatagattcaatatgtctaaatgtatataattcacagtttttatctttgatttgaaattaattttagattttacttgagaacttcacaacttcatataattttaaaaactgaagaccagattgtggaatcataaaatctaaatctaaatgggaatcacttttttaatctgtcctggttacctacctggagatttgagaagagtctttaaaaagaagaatccattttcttagggaagatctggattgccagatcagtctcaccacttcagcctctacttaaaggcattatattcccccgaagcaatgttttgttttagctgatttgtctgggggtgtgggacgtggtgttggttcacattccatttggttgaatagacatccagcttattccagtggcttttcataccgtcctactgtgatgtctgcttattactgattacttcccttggctgactgacatgctctgattgtgcaattggattaactttcatggttttagttttaggaaagcagctcttttggatctatttcattttagttgtcaagcagaaggtgaaaggggaagagaaattaatatttaatcattccctgttatgtgccaagtattagatacatttacagccactattttatttaatcttcatatcagattttgacaatggttgctattatcctcattttacacggtcacataatcaaagggaaatgaaattggtcctttatcaatgattcaggtgctttacacatgtaaattagagtccaatgtcaaacgtttatttctgtgaaacaagaggtttacacctgaacaagaaataaagtataaaaataaaatatggcgtaattcaataaacaaatatggagcactgactatacatccgatgttttactaggtatttgggattcaaaaatagaaaagagtgggaatcatttgaagatggttataccctagaacaatgaactcagtcttttcttggaaatttatctttcccaaatgtattgagtgtcatatatagtaatataattgataattcattcgaaacatatttagtggcattttcttattaattaatatgcatgagtctattttctcctgaaagaatctagatcagtgctttcaaatagaactcccgtgatgatgaaaatattctgcatcatccatttttgtaacgactagctatttgtgccttttgaatacctggagagttggtcgtgtgactgaggaacttgagattttattttagtgaattttgattaacttgaatgttaatagcgttgtatggctaatgggtactgtagcagacacagtaactttagttgacaaaaatgaagtgttaacaccatggtgattttggaggtcttgggaaagggcatacactatgtggtggtgaatgagttcgagaaatttagggatatgaagtaaaaaatgaggactccagaatgaaactacccaaatttgaaccacacctttgttgcttgctagatttgtgtcctgggagctggtatttaacccctttgtctcagtttccttccatataaaatgaagataattggatctacctgatataattattataatatgaagataaactaagataataaatgtgaaaaggttagcacagtgcctggcactgtgtatattgagagtcaatactctcaatgtcagttacctcttaagatgataatgcaatttctcagcagcaagctacggtatgctatggcatgctatgatacccaagaggctgatgaatttgttcacattgttctatttctgatagagagataggttttcagacactaactttatttggagtgttgctttaccatctcacatttttctcttaaaaaatttatgagggataatataatcgtttattttctacagagatttatctactgagggggtgagtgtttcagtcaatcagctctgtgctcagatagaaaactgttggtatttgaggtaccactgggccctcggtcaagtcgcttcattttgatagactaatcaatagaagcaaagacaaggtagttggaattgtgctgtaattcattttaaacgttgttgcatttgtctgtttcagttactggtggaagagttgcccctgcgccagggaattctcaaacaattaaatgaaactggaggacccgtgcttgtaagtgctcccataagcccagaagagcaagataaacttgaaaataagctcaagcagacaaatctccagtggataaaggttagacattaaccatctcttccgtcacatgtgttaaatgttgcaagtatttgtatgtattttgtttcctgggtgcttcattggtcggggaggaggctggtatgtggattgttgttttgttttgtttttttaacctgaccgtttgctttggctatatgttttgttgtggctagaaaaaatgatgatggtgaatggctttacattaatgaccaaatgccaaaatttataccacaattttttgcataaattattctgaagaatcagactgaagaaatggcgaagtatttaattcagtggccaggcatgtactgacagtatttaagctgaaaggacgtggtctggttctagttaaacaagtgtcataaatcaaaattaattattcacacctgtggtatggacttaataattaatgtacactaacgttcgccacaagtttatttatttacttacctactgatttattaacttgtgagttttcatctttccaccttgcatactatataaatctaacagtaatactatttattaaattaatacatatttattttatataaagcaagtggtacatatgaatttatagtaaaaagcaacatcaattgatccagcactattcattcaaagacaatcatttccccactgtattttcatggcatctttgtcataaatcaagagaacttgtatgtatgaatctgcttctggattctgtatcctcttccatttgattaaatctgtactttaacaacagtacttcactggcttaattacaatcttttttttaaaacaatcctaccgagctataattcacataccattaaactcatttaaagtgaacaattcaatcgtatttcggtgttacttttttaaggtgtgataaaatatataacataaaaaattgtcattttagtcatttcgtgtgtccagctcagtggcatttattacaaccatcaccacagtttatgccccacccccaatttttttttttcttttttggagacagagtctcgctgtgtcgctcaggctggagtgcagtggcgcgatctcggctcactgcaacttccgcctcccaggttcaagtggttctcctgcctcagcctccctagtagctgggattacaggcacctgccagcatgcccagctaagtttttgtatttttagtagagatggggttttgccatgttggccaggctggtctcaaactcctgacctcaggtgatccgcccaccttggactcccaaagtcctgggattacagcgtgagccaccgcgcccagcctccaaaattttttattactccaaccagacagtctgtaaccattaagcaatagttcccctttctctctcttcccatccgctagtagcctctggactactttctgtttctatgaatttggctattctagatcttttatataattggaattatatatttgccactttgtgtctgccttacttccctcagcataatattttcaaggttcatctatgttgtagcatgtgtcagaacttcattcctttttatgactgaataatattccattgtatgtatatacgcaatcattttatttaaacattttggatctggttgtgtaaaccttccactttgttcttcctattcaagattgccttggctacttttggttctttgaataaattttagaactatattgtctatttttacataaagccttccaggatattgattgaaattttgtgaatctggagctcagtcaacatctttacgatactgagtcatctaatttgtgaacattttgaattgtgtcaggttatttattgtattttttaaattggtgatgctgacattctaataacagatcatttacacgactgataaaatatttaggaactaaaataagtaccaattttatgacattaaaaccataatgtgcgcttaagtgtctctatttcaagcaggtagttatttgaaaaaaaaaaatcccttcttggtttctacctttaatgattgcaaaacatctgtgtaaagatacagacttttatgtatggagggaaggtggtgtcccagcaattaaattttatagctacataacaatacaaatgaaatcatccctcataaaaagagaacaaggaggaaggatacccaaaatgttctacaatatctcagtacatcttatgacaaaaagaagaacaaaaattataattgtaggaaatgtgagagaactatctaaaatatacaatagcagctttgtgggttgtgaaagagtcaaggttttatgtgtcctgcaacagaataaaaagtcaaatttttatgatagaaaattaaaactgaggttacgaacaccatcatgtatagacttatattactacagcatccataatatctgtttcctatgccaaaattataattttaatgcaatgtctttgccattaaatgccacaggatttggaattttattcattagtcatattaaaattatttaatcatcttttctccatccatatgcctctgtatccctgttagtttagatttagggatagaaagcaaatgatcagtaccagatttaggtaaataacacaagtttttttaaaagtaaaagaaaatggcttataacactggcagacagtcttgatcttcattaaatctcaagctcttacttattacaggagggtagaaataaagcggaccccctccctgtgtcctccagccctacccttcatccaaaggttagagtgggtgatataattggaactagtgggtcatagttactgtgacatgaatatgtcaattccttagtacatagtatctccaaacatatcctaatatcataatcagttggcaggtgactttctccacagctaactctaatatgctgcattctgcgtattgagccaactgaccccttactcttgtacctttattttatttttttttttatttattttttgagacagagtctcgctttgtcatccaggctgcagtgcagtggcacgatctcagctcactgcaacctccacctcccgggttcaagtgattcttctgcctcagcctctcgagtagctgggactacaggcgcgcaccaccacacccaactaatttttgtatttttagtagagatggagggttcgccatgtcggccaggctggtctcgaactcctgacctcatgatctgctcacctcagcctccgaaagtgcggggattacaggtgtgagccaccgcgcccggcctgtacatttatatttcattactgaagagagaaaacagcaggtgaagataatatagctatttctttaagggagtggtggacagggttgctttaaactgaatatagccattagcgtaaatttatgggtagcttcatgcaatgaaggctcatgaaatgatatcctcattcttgtctaatacataacttgaccttttacagcctttaacaatgatacccgtaagagccacaaagtggggatgttattaaagctagcctctgtgttcctctctctgatcatctcattctatgatcttcacccacacttctgactcaggtgtttttaatatttatccctcttcatatttctttgtattttctctgaacatgcatgtgggtgtaggaggctctctcgccatcatcatcactctcttcctctgtgtttctcacttttaggctaattttcatctatgaattgacacgtatattataggaatttatttttatatatttattaggaatcttctttttgttttttttttttttttgagacagagttttgctctgtcgcccaggctggagtgcaatggcacgatctccactcactgcaacctctgtctcctgggttcaagcgattctcctgcctcagcttcccgagtagctgggattacaggcatgcaccaccacgcctggctaatttttgtattttaagtagagacggggtttcaccacgttgatcaggctggtcttaaactcccgacctcaggtgatctgcccacctcggcctcccaaattgctgatattacaggcgtgagccaccgcacctggccatgaatctacttttctatttgcatatttgccactctttttctgccccagttgtttatgtaacacattctcttctgctctccttccctgaccccgttaatcccagtttcatctctttcatgtctttttattttgtgtcccctttcctcattcttcattgctctttgtatatgttatatgtgggtatttttttaactacccatttatttaaaaccaaaatatgctttatcattctttatttttgaacaccgagtcctagaaaggttatgtgacttatttgagaccatgtagctttctatttaaatataaaagtgattccaaaataaacagtaggggttttaaccttttggtgaagctcaagtgatttttatgtggataatatcctaatattaaaatggggatttattttcttttaaaaaaactatatgagtttttgctttggtttttgccctttttgagaactagatgctgtgttttaaaattactttctagaaccttctctgctgtggaacatttacagttgtgtaatatagcaaaacatgtttatgttgtttcagaattagttaaaatcctactatttttaatgtcaagtaattttacaggtggtgtacgttatgcattcctattagttttaataaatatgttgtcattttgttaaataagtttaaatttttcatcgcattttacatgtaaacagtaatttactatctacacataaaataccatttacaaataagatatactgtttatatgtaaatggtaaattactatttgaatttgttactgcccagacagtataaaatggtgcacataaagaaaaaagcattttggaaaacaattaagaaatttggctggaaagtgaattttagttaagtgcatcttattcactttaccgaggaaaaaggtaggtttacaaatacaacatatataacaaacctttaatatgggaataatttttgtaatattgataataatacaggtattattttcaaaaaatcaccaaataaaaattatgaaagtaaaaatacagtgcaactcctagcacaaactatcttccacaatatacagttggctgtatctaaatttccagaaatctggttcattttgtattaatctctaatcatgttgcttctaaatatgtatctgaggagtaaacatttcagatttattttcatttgtataaggtaaatgaatgtttagtctttttccagacgtatttgctatgtaatgacagtcattattagtcgtcagtataaatgtgaatagcaaaaaggagaaaattaaataaagctagagcttggctttccgactccttgctcaaaaatggacactttgtccaatcaatttcctatcacaagatgacgattaatagattgttctaatagttaccattcagtcctgcccttaacgtgatgttttttcaaccaaataatagaatcttcactggcattgttaccatattgactggtatttatggaaccccggaaaaaaaaatgctgtaaaatatatagtaggaagtataataatcattataggaaatcatttctctagctggaagtcttagcagggaccagatagttccactggagcttttatgtgctcatgattttctcccttgaagtgtatttgtaacacagttcacacagtttttaattttataaatctgtgtgctaaaacgctattatataagaaaacgggccgggtgtggtggctcacgcctgtaatcccagcactttgggaggcccaggcgggcagatcacaaggtcaggagatcgagaccatcccagccaacatggcaaaactccgtctctattaaaaatacaaaaattagctgagcgtggtggcatgtgtctgtaatcccagctatttgggaggctgaggcaggagaatcacttgaaccagggagtaggaggttgcagtgagccaagatcatgccgctatactccagcctggcgacagagcaagactctatctcaaaaaaaaaaaaaaaaaaaaaagggtgttcacctatttattgggcatatagtctgatagttcccagaaacccattatcttgaatgttttctttatgtaagttcctggaaatccattatttggatgttttctttatgtagttaataattacagcaaagctgtaattaaattatttattcaagagctatctattaaaggactactatgtgccacattctgttctaagcatatcataatcacttcccacccttcccttatttaaaggacatgcataattttatagggcttggcattataaatattcatatctctaatttatagttgctaaacagtttgaagctgagggttgggggaagggagtagtaatttaaagtttataacataagcatccttgactttgcctcctataatttcacactgacatgaggtttattactaggttgtgtgtcatgagtacatctcaatttgctctgactgttctggtttttgcctgttatcctatcataatttttaatagctccctctttcattgtcataagtattccactttagaagataaaatatatagagagggtcactctagttatgagaacaaacatcaggcttttagagctaggcttggtccagtgctcaataactattattatcatgattgcttttgttcttagtagcatcatcgtccttgtcatcatcatctaccttcctaatactttagttcagctgagaatttcggcctatccaagaaatctgattgccattattaccgaattaatcactctttaatgacaatagtatataagaatacgtgacatttaactttccaaattattgaaatgttacgctgtgtatggaaaattctttctaaccgtgttttttctctactctcaaatcgtaacaatcgtcaacacagaagaagacttttatgaccaaatttgtggaatttttttccccatacaccaaacagcaggcaccagctgggtgtctctaattcagtcctgacactatccacccagagatagtgtcagatcccatagattgagggctcagtaccgaggtctgcctcctctgcacccccctagcgcacgcgcgcgcacacacacacacacacacacacacacacaccagtctcaagtccaggcctctggaacttctgacccatgggcttcaagttggggttcccatgaccctctctttgggttcaactaacttgctggagcagctcacagaactcaggaaaacactcgctttcacctgtttatgataaaggatattgcaaaggacacagatgaagagatgcatagggtgaggtatggttggggtggagggacggaaaggggcatggagcttccatgccctccctgagtgcaccaccctctaggaatccccacctgttcagctacccggaagctcactggactctgtcctctttgttttttatggaagcttcatgacatcagcattccttccccaagggtatatggtgggaccctctaacaggaggtttttaagacctataatctgaaaggcgagggaacattaaagtgaaaggagagcaggagaaggtcagaggcctgcccctgagacccaacgcaaccaacattataacaaaaaactgtaacaagggctatgggtgttatgagccaggaacctggatagaaaccagtatgtactataataccatataggcaatgccaagaatatggatcagacactttacaaacaaggaaaaagtaaacaggagtgatgaggaggtaatttactgcaggcattaatgatgagattatgaattatggattccacttgctaccagctatgtgatcttatacctactctgtccatacctaagttataacatccataaaattcaaatactaaaagaagacacttccccaggttgtggtgaaaattcaatgaggtagtaaatgggaaatgtgtaacacagtatctggcatattgtaattgctcaaaaaatgttagattaaaaacagtaggagtaatactaaaatagaaaaatgcaaagagcaagcacaaaatcatctctgattctcacctccaaattctccaaaagtctcaccttcttaatcaaagttgtaaatatggctcttggggagaaagctgaactatgtgctactattatgaatgcaacaggtgaaggagaggagagttagaggcagcaagacaaccaaatggctctcgtggaaggcacagaggattttcagccactgctctcctattccgctgatattactttcattttctatgaccaactagcatttcagctaaaatgtgttggaaaatgatagatttttctcctcctattgcctaagaagcccaacaaagccagcattgttttcaaacaccagcattctcacttttaaagtatgaacataattcagaggacttttaattctgaacatcgtttttatcaatctattggcctgattgtaacccagaaatccaagcagaaagcaagtaaactttcacactgcttccccatcccttccccctacctttatttttgacatcagtttccctcattttggcaaagtaaaggaaaagcatttgtagaaggttacactgaagctagataattttctattaggaaacctcaccaaatacaagataatttgttcattccaatataataatgttttaaaaaatataacaaaaatccagcataaattgtgaagcactgatacttgtgtaacaactaatttccatagtgaaacttcattgttgccactatctacatactgaaaatgtatatcaagcatgtaaatgtgtcacttaagtatgctgtgccctagattttatttaaaagttaagctaattttcaactaaaaacaaattcgactattcttagcaatctctcctccccgttcatgatggatttaaaatgatgaagagtataaatgatgatgaaaagagaaaggaggagaaaaatttcataactctgcatcttcagtgtagcatttttaagtaactcctttattagcacaaaggtgtttgcctgaagcaatgacttctagaaaggagaagaaatgacataataaaaggggattttgctaatataaaatgttttttctttccttttgtttctgcaatgcttttacttacatagcaccaaccctgagactagagggagtttccttcctttctaataatttaataatcgtgaaatgatattaaatggaagttttcatatgccaactccttaaactgaggttaaataaggaacaaagattaaaggccatatttaagaccacatattgtaaattctaacccagtttcatttattatatcacctgcaaagccaatatgccatacaaaagtaaaataacagggtgatttttattaaagatcagaatcataccaaaaatgaacttttctgtcaaatctttatactcatacatcaagatgtgagtttatttatgtagctaaaataacttaatactaaatgctgactactatattcatgtcagctgacccctagtgcttcaaaccatagaaaagggataccaaatgctgggttggttgtgtattccatttttgccgtataccacctgccaaggcttataacagatctgtaatgggtttcttaccttttattgtgtagaaaatggattgttggattaggcctggggccagtgaaccatggaaccccaggtttgcaagaaagagtttatcaccctttgatgttatttctgtctcgtgtcagctgagaaggatgagctagattatctgaaagtaagctggatgccaaaatcagcattcccctcatttatccaccttatggttcggggcaagaccactgtatgggtaacaaaagggctgataagggcctgatggagaaatttggtttttctcccttttgattggcttgctgatattagaaccaattacaagacattgacgagagcatttcattgtttgttgctagagaaaatccatcaattttgttgtggaaatgaaagcatttgagctgaatgttgcacttataatttgtgaacattttcagttatcaccgggacaagtatagtccatctttggcatggttggccaagtgtggtgggaaaagagatggaccagcaaatgggccggaaaccaaagtcatcaaaagggtatttcaagaaaactctatttgttctgatggttacattctgcaggcaacctgtgactgatgactgatgcttatacctcaaatgcagtctaaaaatatttttttgtgaaagtgacacattctgactgtgatgtgggtgacatcaacagttttgaataggacagtacttcttggacttattgaaacttttataaaagaatgaacattctgaactcaattgcaatgtaaatgactatcatgaagattgcttctgttggtgctatgacttttgtgacaaattttagaccattgcagttatctcctagaggttgctttattgttttattttcatcagtgatgtgtattttatcagtgatgttagaatcactgagctgctggttaaggaagagaaaaaaattaatattcaggtgctatataggcccttattcattgagaacaaataaaggccaacacacaaaacaggaaaattaatagaaaagacactctatgggtaagatttcatatagtttgggagcagacaaaaactattttaattactaaaataattaagaaagatgttgaggctgggcacggtggctcacgcctgtaatcccagcactttgggaggccaaggagggcaggccacttgaggtcagagttcaagaccagcctggccaacattgtcaaaccctgtctctactaaaaatacaaaaattagctgggcgtggtggcacatgacttgaatcacagctacttgggaggctgaggcaggagaatcatttgaacccaggaggcggaggttgcagtgaaaggagatcacgccactgcattccagcctgggcaaccgagtgagactctgtctcaaacaaacaaaaaaaaaaagattaaaaaaaaagatgttgacattaacatgttcaagtctttatgctgaaactagaatgcagtatgattaaataatcatttctacttcgggtgaaggattagttttcttaaagatacccctttccagcttctcagttcgcgtgtggttaattcccaacgtggcctcaaatattctaatggtttgtgtaatgagtgccaccgttccaccttcttattctccatgcctcatctcagtcctggaaagatcactaaacttgcagttcataactcagtctagacccaggttcaacactcactaactcataactgtgggccacttatttaaatctcttagtgcctctagttcctcatttgtccaacagtgatgcattatgaagcatgtttgcccatctcccagcgtctagtgaggaactaaaaacacaatatatactatcatactttattacgaggagttaaattgtggttactattacaaagtaggttaccataaaattctaatagcagtggtaaggggtaaagatccacgtgccatcacgtagagcagaacttctcaaactttaatgtacggcaggtccttgaataatgttgtttcattgagcatcactgtgttataatattggcaagggaaaaaactgtatctcagctaggggggcactgtctatgtggggttttcttttgtctctgtgggttttcttctagtactctggtttcctcacatgtcccaaactgtgcacgttaggggaattggtgtgtctacattgtccccatgtgagtgtttatgtgtctacgactgtgccctgcgatagaatggcatccctgccagtgttggctcctgtctggtgctctgagttgccaggatgggctctggcctcccaagtccctgaactggaatacgtggcttggaaaatgaatgactgaattaatataaattactgtgaaataaaaattcatatagtattcaataatcataaagatgcgtgacaataattgatgctctacagaagtgctcagtgagctgccatattgattattgtttgtttttgaactttgtggtgagagaaggcaatcctggcagtttatgctttgcaaacatttattccttgaatgaaccaccgccactgcaaacactgtcactcactgattcaccaaaaactgggtaaataattttcctcctggtttttattaatctttctaaagtggatgtatatctcacatttatttctgagtttaatattagaagtgcttggggtctttatttagatgttggatcatgttttgtgaacacaggtatgcagtaggaacttaattcttgtttatcaattagcctatggtaagattggtttcattatatgtcattttgcctaagtcacagtttcccagaatctatcaacaacattaattgatgacttactgaaacaggaatcaccttgagatcttgttaaaatcaggttactgattcaatggctcttgcataggacctgaggttctgcatttccccccctaatttcaagatgctggttccctggtccccttgctctacttcttaaatggtagggaggtagagagtggctatcaagagtctgtgtaggagttgaccaccaatcccattcaatggaatgcatacagtgtgttctgagatactggaaaggcctttgcaaaaagattttgtctcttgatatttatgaagcacattcatccgaccacagaagatacatatcaactttgacagaaaatatgaacacattcaaatgatttatacctttgaaacatagatcgttgtggggttcataacccaagtataactttcccacagattcactcaatttccttcctctttctgtgcaatatattgtatattgcaagaagctcacctccactcaccttattcctcaggctttcttctcaactatcttctgtatagatttaaccagtgggaggcgttggcaggagattggagagcaggagaaggggagatttcagggtatttctttccctctttcactgctttgggcaacagctgatacagagtaagtggccaaaaaatactagctattattaggtcttctaataatgatcttctaaaatcactttttcagtggttacccccattgatttgccatgaatgtctcttcagacatctttgcaaagaattgagcctgactttagatactcattcaaaatcaaaatcagtaattttaggattgaggactctggtattatttaagaactcttaactgtaccaagcctcactcccatttctggctttcccctatatatcagttaagtaataactccaatagtgtaaaatttgcaatagtgttatgtaacaaatcaccctaaaacttattgacttaaaattatcaccatttataattgcacacagtctgtggggtcccgtgagctgttgtgttgttctggctcactcatacattttcagtcagctaatgggtgggctaggggctggcttatctagcataagcgcagctaggatgattcacctctgctccatatggtctctcatccttcggcaagcgctcctgggcttattctcatgcaagaaacaggattctaatagagaaggaaacaagacttcttgaagcttaagcttggagctggctcactcatttctaacacatttttttaaccaaagcaaatcacaaggcaggcccatattcagggattagggaaataggttacaactcctgatggtagcaactttaaaagtcacattgcaaaaagatgtgcatacagagaggtcaccagtgcaatctaccacaccttgcaatctattaagtttctcaccccctcacaagtaaggtattcagttaagatgcattcctatgtattcagatttctaatcaactaatcctgattctcacgtaatattgacacagtatcaatattctcaaaagccaatagtctagagggtcacaaagatcctcaaagatactttatgcaaaatcctaggagtatagaaacagtaccttggtttatgtatacattcagtatttattaagtgtttccaatatggtataatgttaaggaatgaggatagagttatgaacagacagacacttgtctttatggatcttacatttggagggggacaaacattaaaatggattatataattacaaatgcagccgttctcattgtcttttcagatttctcagggtgtagactgagctactataataaaaataccccaagtttccatgtttcaaacaatatagatatgtgtatctttcccacataaagtccagcctaggtacgtagtctctgctctaaaaaggaacacaggctagcaaggcagctatactattctcaatataatactgcatttcaaaatctccatgctggtcccacaaatatccatgcactctctttcttatcatcaagagaacacacagtgccttcccaagagagaccagtcaaagtctcattcacttactgcatccagctaaaagtccattgtctgtggatgatgcactgtcttctccatcagatcaagatatggttcctcatggtccagtgacctataaagtgaaagttatgctatctgctcctaccacaaccaattctctctttttaaaatttttttaaatttttgtgggtacatagtaggtgtatgtatttatggggtacttgagatgttttgacacaagcatgcaatgcataataatcacatcatggagaacgggggatccaccccctccagcattaatcttttgtgttacaaacaatccaattatactcttatttatttttaaatgtgcagttacattattttgacgatagtcaccctgttgtgctatcgaatactgggtattattcatttttcctaagtattttttgtacccattaaccatcccgctgccccctccccgactcctccactatccttcccagcctctggcaactacctttctactctctatgtccatgagttccattgttttgatttttagattctgcaaataagtgagaacatgagatgtttttctgtgcttggcttattttgcttaagataatgacctccatttccatccatgttgttgcaaatgacaggatctcaatcttttctatggcagaatagtactccatttgtgtatatgtaccacgttttctttatccattcatttgttgatggacacttaaattttttccaaaccttggctattgtgaatagagctgcaataaacatgggaatgcagatatttcgtcaatatactgatttcctttctttgggtatatacccagcagtgggattgctggatcatagggaagctctatttttacttttttgaggaacctccaaactgttctctatagtggttgtactaatttatattcctaccaacagtgtgcaaggttttccttttctccacattctctccagcccaggcacaaagacagcagtaagtgctggacgaccacctatgcaagacctagactataaatccagtacttctctccctctccacacccccatacccaccactccattctgagttttcaaatgtaagctaagctaaatgattcaataaagctttttgaagtcaaggatgagaaaaatcgttgctttttatgtaatcccaccatcaaagtaataattgcttagttcaaattgtggtgatgcaaacaaggaaagcaagagagcataaaacgggtggatctgacgcagtccagaagtggaggcaatggttgtttttagataattattagagaagatactgtgatttggtttgaaggcaaagctcactgaagttctctagttctagatacacctatcgaaaaattcttacccaaataaatgtctcagtgataagagcagcctttccccaaatgcctaagtgtttttgttttgtttttgttttgttttgttttgttttgttttgtttttgtttttgttttttttcaaaatcttcctctggaatggatgctgaccttgtcattgacttattcttcaccacaactcagtcatattaatcttgaaagagacagagaggccactatctctgctaataatttacataattgtttttctacaatttggtgctaattaaaatgtgaaaggggtagtgatgatataggtaaatgtaataaggtcattctttgttcctgagagcaaagataatgtcaccagaaaggattgtctgtatattcacataagagcaggaaacaggaagagagacacagtaaggtaaaatagcatactagtatatcacgtagtctggtatagccaatgtagaatatttatttcaaaaaacaaataaagataaagttctgcttcactttgagaagctgttttttttaatcctgtatagttagttcgacatgttactactctgcctggttcaaattttgatttcactctgttccagttatatatgctatgcaacaaaccactctaaaagttactggcttaaaataagatagttttacgatttctcataattctgagagttgactatgatattcatctgcttcacctgatatcaaccaagacactgggaaagctggaaagtccaaaatggcctcactcacatgactggcagttggtgctgcctaccagctgagaactcagctaaagctattggccatgagcctcagtttgtttccattgtcttctccatgtgtctcctttggcttccccacagcttggtggttgagttctgtgaagaagccttccaaaagaacaagcaccaatcttcaaagacttatcaagcttctgtttgtatcacacttgctactatcccattggccaaagccaggcatatggccaagttcagaatcaaaatgagaagggactacacaaaggcatgaatccaagaggcgtgattaattgtggggctgccaaataatcgccttccacaaattccttactagctgtgtcatctctctgtggtctcagttttctcacctggaaacaggaacaaaaatggccctacaaaaatggactgagatatattaggttggtgcaaaagaaattgcagtttgggaccgtgaattttaaatcattataactaggctcaagcacatctttattaatcaaagtaggaaccgttacagtcaacacatttttgccaagaagaaataagtgtgtttattcctgtagcataaaaattcatgctttgggattcaatgaactcttggaaagcattttcttcatcctgctagttgtggaagcattttccctgtaaaaagttgtcgagatgcttgaagaagtggtagtcagttggttgagaggtcaggtaaatatggcagatgaggcaaaacttcctagcccgattcattcaacttgtgaagcgttggttgtgcgacgtgcggtcgggcgttgtcacagagaagaattgggccctttctgttgaccactgctggctgcaggcatggcagtttttgatgtatctcatcaatttactgagcatacttctcaaatgtagtggtttcgccgggattcagaaagcggtagtgggtcaggccagcaggagaccagtgaacagtgaccatgacttttggtacaagtttggctttggaaagtgctttggagcttcttctcagtccagccactgaactgggcatcgccagttgtcgtttaaaatccactttttgttgcacgttacaatccgatcaagaaatggtttgttgttgttggcgtagaataagagaagatggcacttcaaaatgacgatacttttattttcgctctgcttatgaggcacccacttatcgagttttttcgcctttccaatttgcttcaaatgctgaacaactgtgaaatggttgacattgagttcctcggcaacttctcgtgtagttgtaagaggatcagcttcgatgattggtctcaatcggtcattgtcaacttctgatggccagccactacgcccctcatcttcaagactcttatctcctttgaaaaacttcttgaaccaccactgcactgtgcgtttgttagcagtaacttggccaaatgtgtttttgacattgcgagttgcctctgcttctttacaatccattttgaactcgaataagaaaaacgctcgaatttgctttttgtctaacatcatttccatagtctaaaataaacataaaataaacagcaagtaataagtcattagcaaaaaaaaaaaaagtgagaaatgctcattaaaatgatgtataacataatcacatttatttaagaatgtatttcaatatcaaatggcaagttccatgaatgtgaaaacaacacttacttttgtagtcacctaatgacacatttaagaagctgaaacctgagctcagcacatggtaagacatcagtaagtattagttatcataatttttttagtaattttcctacagagctataaataaaatgaaatactttccaaacagtgataaaactataaagcagcaatacattataagcttctatcctaatctgccttcccctcagggccttaaaatgtgtcatttctgtaaatgttacctctgacatgaaagcaccaacacactgttcagcaattacaagttgattgtgacaagagcctcactctccctatttctttttctcttcctgtcttgctttcccttttccccatcctttcactcactttgataaggcaaactgccatgtagtcacaaaatcctagacaaacaagtctgtacctatgtgggcgatgctgtggatttagtaagggaaacagttccttgataaatttctcctttagccctgggtttccaacccctgtgtcattcagctatagaaatcttctgatattttctcccactggtcattttcactcaggctgccatcaaaatgagactacccaatgttctttccatttgttctgttttcttcctcgcctctgattccctgcctggtccacttagaaagtctaccttttttccttctctcttaataccaccaatctctaaatctgacttctcctttctaatcccatagagcctgccttgtcatctccaaacaagatccatcttggcctcctgttatcctcagcccacagcagtatttcacttacaacgttcgttagtttctacctcagatgtgtcaggcatttagtttgtaccaatattttatttctttttatatctacaccaagcctgcactagacggtccaaggagaaatttaactgattcctgttttgaagtcctccccactccttgggagagttaaagattcctcagtgtgttaggtaatgatagttaatatttattaataacttactgtgtatcgactgtattctaagtgctttgcactgttagaaggagaataacctaagactgtgccaaacagcagtctagaacaaagctgaattccttgcttgcctggcaagggagaatgtggtacatactaaaggattaatacatgttcactattaaattgattgattgtggtggtggtgacagtggtgatgacttttcaagtgtgggtaaagtaattttttccaacaaatccacatccacatatttaagaaaagagagacatttcattctatctttttgtgtgcctttgagaggacacccctggcacccaactcccaggcaaatgccaccatctgtgtgattttccttcatttgccaacgaaggcacagcaggtactactaggttaacctttgctttcgcaagtcttctctcaaaatagtaaacacttcagctgttggaaagctctaatctcaaactgcaaatttaaaaatctctctctggagttcaaaaaatagaaagaaaaaataaaaatctctctcttctggaacataatgtttgaactgttacatattattcacactatttcacattatgggattatgaaatatggttttaggtgttagaaaaacgaaagaaaactattatttgttaacactaaccgagagatttttatgatattcaagtaaaatgatagaatgaattattttaaaaatgcatgaatcttcaccttctgtgaagtgtcatggaggattagttctaactaatatgcctgtaagtaactgacttaatgcgtctattggttctcttaatgctgtaagtgacagaaaactggtctcaaactgatttaaacaataaatatgatcaaggttccggttttttgtttcttgttttttttttttttttttcacatttctctgggttctatttttctgtgttgacctagcagcttcacctgacttccctcttggtgacaaaaatggcctgaagccgtttcagaacccacatctgcaaacttacttttgatgaaaatcatctctttagggaccttctttcccaaagcatccaggaaagactgctctgaaactgactggcctgaattaggtcacatgctcattcctgtactaaatcacacctcacttctacagctaaaagtcattaaatctcaaccaaactctacagctgcaccacaacaaaggtagagaagtaggtgcaaagttcctcaaaggaacgtaagggtgaaagatgattgactgataaacagacaggtagacagaatagatagatgaattaggaaaagataaccaaccaatatctgtcacattgctttgacttgattttttagtcaattaatgaaactgaatggtaattttgacattacaacaatactttccaaatgtaggcaggttgtggagatcatttaaggaaaaaatgtatgaggtgttgtagcagatactgtcggtgccccaccgatatccctttagcacttaccatttttatacgtgcttcttaatttccaacttcctgtacttgcatctctttgcttggggctatctctgctcattcttgggagagagcagaaatgtagcagttatgcccctgtagagcagcagttgatagatcaataccctgtcccccttgcccttcagatctaataactccaagcttaattccctacatctttcatataagtatatatataagtatatatatatacttgaagttctagggtacatgtgcacaacgtgcaggtttgttacataggtatgcgtgggccatgctggtgtgctgcacccattaactcgtcatttacattagctatttctcctaatgctatccctccccagccccccaccccacgacaggccccagtgtgtgatgttgcctgcgctgtgtccaagtgttttcattgttcaattcccacctatgagtgaggacatgcggtgtttggttttctgtccttgtgatagtttgctcagaatgttggtttccagcttcatccatgtcccttcaaaggacataaacaactcatccttttttatggttgcgtagtattccatggtgtgtatgtgccacattttcttaatccagtctatcactgatggacatttgggttggttccaagtctttgctattgtgaatagtgccgcaataaacatacgtgtgcatgtgtctttatagcagcatgatttataatcctttgggtatatacccagtaatgggatggccgggtcaaatggtatttctagttctagatccttgaggaatcgccacactgtcttccacaatggttgaactagtttacagtcccaccaacggtgtgaaagtgttcctgtttctccacatcctctccagcatctgttgtttcctgactttttaatgatcaccattctaactggagtgagatggtatctcattgtggttttgatttgcatttctctgatgaccagtgatgatgagcattttttcatgtgtctgttagctgcataaatgtcttcttttgagaagtgtctgttcctatccttggccgacttttcgatgaggttggtttttttcttgtaaatttgtttaagttctttgtagattctcgatattagccctttgtcagatgggtagattgcaaaaattttctcccattatgtaggttgcttgttcactctgatggtactttcttttgctgtgcagaagctctttcgtttaattagatcccatttgtcaattttggcttctgttgccattgcttttggtgttttcatcatgaagtccttgcccatgcctttgtcctgaatggtattgcctaggttttcttctagggttttatggttttaggtctaacatgtaagtctttaatccatcttgaattaattaatttttgtataaggtgtaaggaagggatccagtttcagctttctacatatggctagccagttttcccagcaccatttattaaatagggaatcctttccccatttcttgttttttgtcaggtttgtcaaagatcagatagttgtagatgtgtggtattatttctgaggcttccgttctgttccattggtctatatctctgttttggtaccagtaccatgctgttttggttacagtagccttagtttcctacatcttcttttagggataacagggagtattaagattcagttgttcacattgatgacttgcatgataatataccctttattggctatcttccctatttcacttcttctcaccctgttgatgtgtcctggaatcacatcccaaaactacttgagctcaaatttttatttctgggtttgctactgggagacccaaatcaagacagttggcttcagtactcaggtacttacaaggagatcatggatatcaattgaatcagaattccatgtcatagcttttcaaatttatatcacaataagttgaaaagatgttgattcttccttccacagtattttctgtttctgtgtgtcttacattctggtgtctcaaaacatggctgcaaccagggaaggaattgaaatttggagtaaatgtcctattttagtaggtctacatttaagacatggacctgaaattgagatcataaacaaaagtagatgtgagcataaagtagaaggtgaggttggagggggaaattgtttggatttactgtaaccaatggagctgcttagtctagtcaaggaatttcaatcatttctgtggagactagatgacttatgttatacaaggatatctctggaaaattcactgtacagttttactaaatctggctgataatatgttcactcaatgttatgatgtcaataatagaatggatattgcctttaaagacaattttaaagtaaatatctcacatattcctactcatttatcaagggctgtgtcattcatggcaatataagataattcttttcactttcaaaatcttccagatgcagaaactttccaatatttgctgtagatgaaagtgtacaatttcacaattcaatgggacaaaaagaattaggaaaaatatgtttcagagagtttatttggtatcatctacaagacctggtatgagacctggttggtgttgtatggaatgaaatatatcagtctgttctcacactgctaataaagacatacctgagactgggtaatttataaaggaaagtgatttaattgactcacagttcagcatggctggggaggcctcaggaaacttacaatcatggcagatggggaagcaaacaccttcttcttcacatggcagcaggaaggaggagaatgagcaaaagagggaaaagccccttataaaaccatcagacctcgtgagaactcactgtcacaagaacagcatgagggtaaccgcccgccgtgattcaattatctccacctgatccctcccaggacgtgtgggggttatgggaacaacagcttaagatgagcttttggtacagacacagccaaaccatatcatagagtttcgaatctgaaaaacaaaagaagctaatttagtttcagaaagctgagatttcatgaaccatttaaaaattcactttataatttttcatgcattttgaagcctttatcctttaaatggaaatggaatagaactattattcgtcatttctaaactgtgcattcatcaacaattttcagaagttaattccaacatgtcttcatcaactctatattacatgttagtacactacatctctattttcatgctataattttttactttttcctcacactttcatctcaccctctcaagatgtgttaatcccctttgctcttttccccatctcgtctctgttgcctttctccccccttcctttttttttaatttctgttctcttttacctgaaatctccctcttcatcttttgctaccaattatgttcttaattggttgaagtgagcaaggtaggaaattctccattttgattccattctctcacatggtttatctttaatatgttttaataaacagtttaacataaatcttacttccaatttaacatgtaaaatttagaaaattggtgaaaaatatgcctgctttttcacccccaaagaaccaagtttaaaaagttttgtgactttgaggcatccttttccctaaaagcaagcttaacagattcttagcattcgtctctgtgtgaaattgtggaaactttaaaaaaactatttgaagtaccaacaactcaaagataaattgtctgttttaaatgcaaggtgctaaaataaaactagaagattgacaatattattcatctttatcactgttctacttaaaatttgaaaattaatgttagaaatgtgagagggtgcatgaaaccttaatggttttatcatttcatctgagtatatatttgatttcttctttctgacattgaaactttaaaattcgccactatttttcagtaactcgttaaaatatggtccgttcttatatttgcaatactcctatactgaaaaccctacaacttcaccattatttaatttttatgttactatatttgtttcttaaaaagattataatattatgtattagttgtctattgctgcataacaattactacaaagataggggcttaaaactgtatctttagagtatcaggatacatatgggtcagaagtctaggcatagattatccatattctttgcttcggggtctctcacaaaggctgcacactaggtgttggccagggctagggtctcatttgaaagcttgccttggaaggacctgcttccaaactcacctgttgttggtaagtttcagttccatgtgggttattggactgtagtcttccttttcttgttggctgatggccacgtttagttccttcggtctctaacatggcaatttgcctcatcaaaatcagtgagagaaagtgggggaggggggaaagagacagagaaagagtgaaattgctagcaagacaaaagtcccaatcttatgtagcctaattggagaagtgatatccttttgtctttgacatattctgcttgtcagaagcaagtcaaaagtcttgaccactctcaaggggaggaaattattaaaggactcaaatactaggagacagagatcactgagtgccattttagagtcttcccaccacggattatttcccttcacctgctggcatttgaaaatgcagctaatactctgggattctccaaacctaatttttttgtataattagagaagtatttgtcataatctgttaagtgtagtaatatattaagaaattgaatttattccttcatatttcaaaaagtacatggggttgggggacagctatgttgtcataaactttaatacatacatgattggaatggattatgaaatatttttctctaagagatagtataaggctgcaaccactgaggctcccaaatacagatgattcatatgtatttagttttaatgcaaagcttctcatgctgatttaaactctcatattttcatatatggtgttttattttttatataatgaatgtctataaaattcctattattttttcaaaagtattgtggcaaatatttcctagtaaaatctaaagatatctttgacgtaatttttatgctctcatttatgttaagaactcaatattgaagtaatgttctttcttatttcctagtaactaaaatccttactatattcatgaagagctgtgcctctattaaaaagcttttattgcaaacagaaatgtcaaaatacagcaaaggtagagctatgtatgattcttcatctgtaatgtaattttaagtatacattttattgcataagcagagatttatacccacatttgctttcagtattcacagaagaattttcatatgtatttcttaaaataacaaaatggctgctttggtgtggggatagtatggtacagcatttattgtgaaaatgattcttatcttccatctttttcaaatggtgagttcagtatgtttaacattgctggttttataatattgcgaatatttttgagaggaagaaacaataagagactgataagaataattcatatttgctcaaagtttaatcagttttttatttgaacaaaaacttggacgaaatgtccaactttcctttgagatcagtgctctccaatgtggtaacaacagcctaccatatgagcatttgaaatatggctagtccccactgaaatgtgctgtaagtataaaacactcaccaaattacaaaacctaagtatgaaaaaaataaaatatctcattggtactttttatattgagtacaggttgaagtgacaacaatttggctatttaagttaaagaaaatataacattaaaattaatttgacctgttttttacttttgtaatgtgtagaaaattttaaattacatgtatcgctctcattataattttattggatgtcattgttctagataaacaatggcaatgttgagaggtgtcataatagggacaattgtctctgtgaagaagaaattatatgaaccctacaacatgtattagccgcagagttgcttagaattgacttactctgtcttgttgaaaataggttttcccttaaaatctctgcctgatgtagccaaccacgattcaatgagcaaacaaaaatcttaaaggggaaaaaatcattttttgagtctattttacacacccagtatcaaaaagaaaaatataaatccacaactaggattatacgggatgtaattcttggatttcttttggtcttataatgctttatacctaggagatgttcaacaaattattattgaatgattgtagtttaaccgtcagttacattttgcagcaatacatttattagtagcaaaatctgagtgtttactaattttcatcacctaatcagcaaattagtactgctcttatatcgctttgcctacgctctactcactggttcaatcagctaattttttcagaattttatggtttataaaccactatatgttgcacagtatttcctatacattagctcatttgagtcacagaagttataggaggtggatcttgtctttctttgttcagaaagagaaatccaggttcagcgaggttaactggccttgtttaagatcagcacgttgctaggtgacagaaggtgttcacttctcactgaactttgcatatcaaaagagatttaaagaattcactttggagagcgggagttatggggtgaatattttatcatgttgtccgtcttaataatcaccaatttgatactaaggctgctagtcatctctaacgaagagaagttactttgaagttggttgattgattgttgttgattgacagaagtattagttttcagaatgaactaattcattaaagaaataaaacattgggtttgttcattccataaataattgaacatttattatgtgtatgataccagcctaagcagatacctaaaaggaatggagattactatagttaataacaatgcattgtattcttgaaaattgccaagagattacattttaaacattctcaccataaaaaaatgataagaatgtggggtaatgcatatgttaattatctcaatttagccattccacagtgtatgcatatttcaaaacatgttgtacacaataaatacatacaatgttatgtgttaatttaaaaataaatacattagaaacggtaaaagtcactaggatcatggaaataaaaatgtttacatttatgtaaatattagtaatataatagagggcatatccaaaatatagtgtcatattaataagatgttgtatgattattatagactacaaaataataaaggaatagacagaatgtttctaaataaagaatagaaattacagtgaagcggaagagagagtaaccctaaacccttcataatcctccctttgcctcgtagtatagcttggaaagtaattatgtggaaagttgagattgcaacaaaggacggtagtacaggagttgcccaaggacagacaattattttctcaaataaactatagcagaagcaaaatggccttggaccacaaaagaaggccctcatgtagacattgttctattctgaagtagaatttgcagtactcaagagaagaggaaagattattataggtggagagactgtaaacaaaatattatggtaggattcctcctgaatagagcaaggtgattgtgtttgacattgaaaaggtatgtttgggcaagagtttgaaaacctttagccaccatgctaagagatcttaaatctttatctctgagtaagggcggtggttgtggttaatgatccttgagcacaactctgtcccattaaagacagtagattcaactgcttctagcattagtccatatcagggagtaaagtgatccgatacattattttcccccagtaaatggttcataaaggaaggccttggctctgccttgtatgtctacatgggagaatataccagaatgtctagaggagcatgggtagcgtaacctttccccatatgcacatacaacaaatactgataatccactcacaggggagggactcatttttaagaattaagttttattttagaagactcagtctgatggcaatgcaggggttgaattacagcaggtagagactggaggtctacaaactggtttgagatatatattttttccggtggcccagataataaggacttgaacagacttcttgctctgggaatgtaaaaggccaggctggatgtaagaggttaggaagttccaaactgtcccacattttcctttcttctgagccctccaaactgtaccagactctgcatgttacgcacttccaaagtcgcttccacattttcgggtgtcttttcagcagtgccccactctactggtaccaaattactgtattagtccattttcacactgcggataaagacatacccgagactgggcaatttacaaaagaaagaggtttaatggacttacggttccacttggctggggagacctcacaactatggcaccaggcaaggaggaacgagtcacatcttacgtggatgggcagcagtcaaagagagagcttttggagggaaactccgcttttcaaaaccatcagatctcatgagacttattcacaatcactagaacagcacaggaaagacctgcccccatgattaaattacctcccactgggtccctcccataacacatgggaattcaacatgagatttgggtggagacacagccaaaccgtatcagtgatgcaaaataaaagaagactgtggagtaaattacacatggagaaaaggaagaggaactaggaagtatagatactgtgagaattaactctctgttctacaaaagaagaaatgggcttaaagtggttccccccaaaactaaaatccaaaggcacataagtcataatgcacactgttacaccgagtccttccagctcttaacttacttgttttactgcactacacttgacttgagttttagacttagtaaatctgaggtaaatgcagattgagaatgagaacaaaatgttaaaaagagaagcagtctcattttcttactactaataggcattgcagtttgtgtgggctctagcagggatgtttgtaccactgggatctaagcatctatttctatattataaatagaaaaattaggttgagctatcgcgactccattacaaacttatggaattagattctctggtatggagcttggatatacatattaaaacaaaataaaacaaaaactcctacccaattgattctgctgtgtgctctagttaagactgttatggttaagaaaataaataatcgctgtatggaatgtatatcgtcctattttaaattaataaaaaaaattttgcaggccttcccaccttccaactcctagagacaacaaatccagatttgaaaatcagtcatattaaatagttgtatcgatatttaccctttgtttctacgttattattttcttcaattttcacacgtatttgttcatcagttggttatgatggacttcactttttttcagtcttacgaatgagatttctccctccaaaaatcaataggcacctgctgattttatttattccaacatgaagttgcagaaaatgaatatggccaaaaatggttaaaaaaaaaaaagcctgttcttcaaaagactagatcgtcagttgaagcagaaaattatattcagtgcactggatttatgcattgttttagccttctccaaccaatttagaaatgcattttcttataaaattgagattattacaaatcctgtgctaagcagctgaaataatgtgcctatgccaaggtcatatcttaaaagtttggaggagcacactgcaattgaatataagtttataaatgtattccacatacttttctgatatattttaataatttaatttttacattttacctatattgtcttcattttcactttacctttggtggtgtttcatacatattcattgtttggaagaaattaagcagacagtattctaaagtcaatactgagtctgctaatgaaaatggttaagttaattaactaaatggcaaccttcactgaacttattcaaagctatttcccctcatgatgtgttttcctgaagaaatgatgcataaaaactaaacccctgttattcgctattcttctgtatcagcctctaaattgtcactttacatgttacaacctgttgcatgatgattaattatgacaatttaatggcatgtaaagggtaaaaccctaaaggattactcaaaccatcattccttaagaaaagaaattgtaatgcctaggttatcttctagggtttttatggttttaggtctaacgtttaagtctttaatccatcttgaattgatttttgtataaggtgtaaggaagggatccagtttcagctttctacgtatggctagccaattttcccagcaccgtttattaaatagggaatcctttccccattgcttgtttttctcaggtttgtcaaagatcagatagttgtagatatgcggcgttacttctgagggctctgttctgttccattgatctatatctctgttttggtaccagtaccatgctgttttggttactgtagccttgtagtatagtttgaagtcaggtagtgtgatgcctccagctttgttcttttggctcaggattgacttggcgatgcgggctcttttttggttccatatgaactttaaagtagttttttccaattctgtgaagaaaggcattggtagcttgatggggatggcattgaatctgtaaattaccttgggcagtatgaccattttcacgatattgattcttcctacccatgagcatggaatgttcttccatttgtttgtatcctcttttatttccttgagcagtggtttgtagttctccttgaagaggtccttcacatcccttgtaagttggattcctaggcattttattctcttgaggcattaccattcaggacataggcatgggcaaggacttcatgtctaaaacaccaaaaccaatggcaacaaaagccaaaattgacaaatgggatctaattaaactaaggagcttctgcacagcaaaagaaactaccatcagagtgaacaggcaacctacaaaatgggagaaaattttcgcaacctactcatctgataaagggctaatatccagaatctacaatgaactccaacaaatttacaagaaaaaaacaaacaaccccatcaaaaagtgggcgaaggacatgaacagacacttctcaaaagaagacatttatgcagccaaaaaacacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcggtgtggcgattcctcagggatctagaactagaaataccatttgacccagccatcccattactgggtatatacccaaaggactataaatcatgctgctataaagacacatgcacacgtatgtttattgcggcgctattcacaatagcaaagacttggaaccaacccaaatgtccaacaatgatagactggattaagaaaatgtggcacatatacaccatgcaatactatgcagccataaaaaaggatgagttcatgtcctttgtaggcacatgggtgaaattggaaatcatcgttctcagtaaactgtcgcaagaacaaaaaaccaaacaccgcatgttctcactcataggtgggaattgaacaatgagaacacatggacacaggaaggggaacatcacactctggggactgttgtggggtgggggaaggggggagggatagcattgggagatatacccaatgctagatgacaagttagtgggtgcagcgcgccagcatggcacatgtatacatatgtaactaacctgcacaatgtgcacatgtaccctaaaacttaaagtacaataataaaagaaaaaaaaaagaaaaaagcaaagaaattgtaaaatgttgttctatcagaaactcggctaattatttttaaattttagatcaaaaactcaactagttttaatgtactacttataagtcagataaaatcattttttatttttgttttctttttgtttttacatctgttagaaacgatggggtcttcaaagtaaaagaagagatttgcaatgcctataccaaattagttattttaggatactgaatgaaatggttttctatactcaataaaggtaaaagaataagcagaggtagatctggttttctgaaacttgaagcacattctaatttggcagttttctttaagtcaaagaatataacaggacaaatataaaattaggtatgaacatgattatagaaagaaaggaaatcataacaaattatacgtttttaaaaagatgacagataaccacatacatcacaaaaattgaaaaaaataagcagaatgttttcttaataatgaaccatctctgcaatactagaatatacagtgtctgaaataattttttctatctttctggatgcatcctctttcagcacctcttcatgtgagagcatcagaaaataatttactctttcccccagcattgttgattaaaatttgacttctatcattgatagtttagaaaagtttattttacattttcaacttattattggtgatgtcacataaattattacaatttattgtccaatttaggaagaccctgccaagtttctttcacatatgaactgtaaaatttaaaagatcattcaagttatcttgtacaataactaatacatatttttcttttagtcatactaaaccctgatgctaaggatcacccaaactttttcagggaaagaagtagcttgcaaataaatcaaggaccatttatccttactttttggaagaaatggaaaaggataaagtgttagtttaaatacactcaagaacagaatgtaagacaagaaattggaagcagagaagttcatcctcaaatgtaagagtgaaagaatagggttaatgaaacaggaaaggggaaatccaagaaaaattatgccgcgctttagagaatctcctaagcacagagatattggcaatgtgcagatgaaatagctgtcacaggtcagccatgtcagaggtgattccagccactaagtatctactgcagattagatatttggaaagcagaatgagctctgttcatgccattactggggcttgacttcttaatggtttcaagtccccctttgactctaatccttctaaagtcaactttgtataaactcttttcaaaagtgtttatccctgtagaataagttcaaaactccatgtcatggcacacaaaactcttcaaatcatattcagctggtattgttttcttccacattccagtcataactaggatcccaagaattagcaaataaaaatatgaaacatccagaattctaagcataactatgtcccaaatactacaacaaaaaatactgaaaagtatcgattgcttatacaaaatgtaaatggtatcctgtattttataaggcaaccctagtcataagatctctttcttcttcctcacacactgtcaagcttgagccaacagagtaccttttaatgggctgcgcagaatagctttcgatagtttacccattaattaacagaaaattcaaatgagatatcctctgtgaaatcatccttctctcctgcctcctgtctctccattctttctccaggagacagaggccctccagactccatgactttgtagtgtattgtgtctgtctttattagagtattcatcacttggtaattgaattctgtgtttaaatacattttttttcttccagaataagtgttcatagaagggagggatgatttacctagcatactgcctggcatataaaaggccctaaataatttttcttttaaccagtaaccaactaaccaattcaacagttttttaaatgagtgaaaccactttttaaatttttttttaaattcatgcttcacctgtaaaaatatatagatgaattgcaatctggaactctgagtaatttatataaaagtgatgaaaaagaccatggcttcagatttgttgttttaattccagcttcagttcatacaaacattacaaagtcgcagtatctactgtgtaaaaagtttcatcccaatgaagaaattaaaatgtctgtctaatagagatgctctaatggacagcgatgtgtagacttcagaagaatctcctcacacagccttggaggcataagttgggaacagagcaagttctgtgtttgcctttcaaaggaatgttcctttccctttcattgacaaatattataaagatgccccaaaacttctgtgagtttcccccgggacgtaaggtcctctgcattttcctaacttgtttctcaaagcggtggttcccaaggcctgagaatagctgtgtctcagctctctcctggaaaccagagcctaaaatgttgccacatcatcgggaatgtagctgcatacttagccagagccaagagatgagccccactcgcaaagcccatgggctggacaaaattgttagccatttggtgtaggtcattgcactaggtccattacacaggttatctggcaggagtcccggctttggaggaaagacgtttaaatcctgtaaataaatggctggaacaccatggcagttgattgtgttaagccctcatccaaaattgctttgttaggttctattctattgctcattatcttgctgtgaagaaaattaagcttacatctgcttagggtgacagggtatcctgttgtcacaggattttccacattttaggcctatgtcacaagctcccaataaaccctcagagaagatcttttgtgttcacaggcatccaggtgtcaggcagacacagtctttgtcttcttgaagctcagtgacacgttcagggctgtgtatactcctccattccctgccagagacaaaatgtttgtggaacagtcaagctagaagggacctcagaattaatctgatcaaatgtctgcatttttcagttccaaggatactcagggaaggccctcggattctataagtagcggtagaggtggtattagaagtcaggttgcctgacttccaaacctctgttagttactgtcccttcccctgcatgcagcactagtgtaatccctcaactctcacttccctttttcgccacatgcctctctctctttccttcccttgattaccctgcctatccctcctacaagggaaactaccaccaggcatcctcatctgagacccgggaatggaggccaggtcttttccctccctccctccctttcccctttttttgtgtgacagtaacattattcaagtacagctcttccttttttcagtaccttccccctcagaccagaagttaatgaaaaatagggttgcgtgatatgcagcctgggggccaaaaatgtaggacaagcagtgtgcttcagacaaaactgtagggttctggtttcatgcacaaccttggaggacggtggctagaggccctagtatgagagatcaattaaacatggaggccagaaattaaccacatgggattaacatacgtaaggttgcttcttttcaatgagtctaggaaacacactggggacaccttgttcaagacaagctactatttgatgctccttcatacgcttgcttaaaatatttgttcagcatttatttagtgggggcaagaaaaattgatgttatgttaataagaaaacctctttacctcttaccttttattaaaataatcaacttagaagatatactaaaactcacatgacttttgacatctatggatgatctttcatttaatatttttctgctattcctactatagaataaaagctgctattgcattattacagagcgtaatgtgagccacatatgttattttaatcttaatggccacattaaaatagtaaaaataaacaggtgaaatttatttggattatatgttttatttaacccagtgtatctaaaattgtatcattttgacgttgcaatcagtgcaaaaatacagtcatgctatgtgtaatgaggttttggtccatgataaactatatatacactggtgatctaataggattataatacagtaggtttaccatacctttttctatgtttaggtatgtttagatgcacgagtacttgccactatgttagaatttcctgtagtattcagtacagtcacgtgctgcacaaatttgcagcccaggagcattaggctatatcatgtagcctaggtgtgtagtaggctatatgtaccacctaggtttgtgtaggtacacactatgatgtttgcataaggataaaatcacctaatgacacatctctcagaatgtattcctgtcattaagtgatgcatggatgaattaaaatattttggattctttttttttttcagtactatgccttcggaatccaatatgtattttacagcatatgtctattccaaataggcatattctgggctgggtgctcaatagctacatgtggttagtggctaccatattaaccggtgaagttctatgcccatcaaggctacacgtaatttacagggtataatagtattttaaaaattaatttttttctggcttttatgttgacatatcgtttccattttttaaatttttgttttattttctttcactgctttggaaacgcacaacttcttggaatgcaaattaaaagatatcaaataatgatgtagataatttgttattgctaaatgtctaccacttgaaatattcaagtttcaaatttcagctaactgcgattgcaagcttcagctagctggtcccagatggatggcccagctaaatcagacatttgtacatactggctacaaagtgtcccaaaaacagaccaggagggtcgtggatttaaaaaaatttccaccaaaggatgctgtcttgtccattttccaatttgggtaaattaatggatactgcatttaaaagtttttttatttctcgtacattgaagccctgtactgcactcaccaactcacccgttaaagcggctctgaaatacaggcaggaccaagacttagatggactggaggttgggccacaactccttgaacacctagagcagaggtcagcaaactttctataacggtccagatggtaaatgttttaggctttgcaggccaataggtctctgccacgactacttaacaccgctattgtggatcaaaagcagccctaatacgtaactacacataaacgaatgggcatggctgtgtcccgtgacaatttacttggggacacaaatttgaatttcatataatattcatgtctcacccatttattaattattttcagtttcttcaaatgttaaaacaattgttagttctcaaactgtacaaagacatatggtggctgaatgtgacccataagccatagtttgctgccctctgcccaagtctcctgttgaaatggggttatggcaacaatcctcgcagaatataaaactattttggcacctgacttttgccctgatttttttattgtttccagagaaatcaagtatttttctttttcaaatttatatccatattctctttttttctttgctctcttctcttctggccagcaggaagagaccaacccatctttgaattgtattcactttcctcataccgtcacacagctagtaaagctacaacttcacatatgccaatgccaactcttcccgatgttgtgttcaaaacctttctaagcatcaccattcccaggagtagcaattctatatgatattattattttacttgttggtaaggttaaaagttccagggatactgattttcttctttgttagccatgtttcattgagtggataagcaatatgcatttgcttcatagtataaataacaataatgcatcaaattgcaacaatatgaatattacacatagaaaagataaatgtgagttatgtaggtcatgccatttgatagaaaattttttttatatttatatgtttaaacatgacaataaaatgattccattcagatgaaggcaaaggaataggatttcttttcagtgtggtggttttctatttttgttttgttttgttttgttttttagagaatgagttttggagaaaaacaagctttctagacagaaaatattgaaattaaaaccagcaattcatggtcatattattgaaactatcaaattggtatatatatttgaacactactgattattttctaaaatgttacgctttcaaaaaatcatgaagattggcaagttttttagatgcataagcaaatagtgtagtacggcttgtaacactgttcaagataacttttttataatgagtatggtctttctctgccctgtctaatacaatgtgggttttgagcattggaaatgtggtaagtgcaactaaggaactgatatttaaattgtatttaagtttaatacatttaaatttaaagttacattttgataaattgctttgtttttcttttttctttctttctttcttcttctttttttttttgttttgttttttttgaaacaacaatctcactatgttgcctcccaggctggtatccaactcctgggctcaagcagtcctccttcctcggcctcccaaagtgctaggattataggcaggcaccaccatccccagctaaattgtttcttaaatgaaacttctgaatttgaggatacgtgattatgtggtgtagttttccctttctttccccccctgaaatccatattctgaagtacagtgatttatataaaagtaaaaagaaggagactgttttttttttttaaattctattaagaaaccaaattttaacagacacctcagggcctaaataaatatcaagttattgttatttgttatggttcttgttgcttgggtaaaactgtacagatcatgacttagttttccttgaatttttatcaaacaaatgaacaaaatgagcaaacaaaaatattaaaaatgatatttcctacgaatccaagggacatttttctgtatcagccaggctgatgctaaggtccttcaagcaaataagatcaaagatttctgattggagagtgtgggaataaagtagcccttgtttagtgctactttgtagagcctttgtttagagtacggctgggagggagggagagagggagaaaaatacggggttaatttgtaacaacacattctgtggtgtgcgtgtgtgtgtgtgtgtgtgtgtgtgtgtgtgtgtgagagagagagagagagagagagagagacagagagagagattaaattacatttaacttctttaaattttattgtcctcagggtttaaacagtatgtgaccaaaatcacattatttagtgaagagtttgtgggtaggtggatagttagatgggtataaatccctataaaatccattttagaactattgaggtttgagcaaatcaatgtcacctattcacttcatttgtctaatgcctccaggagccattaaagggcttgttacctaactttagggtaggtttagatcaaggtgaacagtcagaaaatattatccatgtactcacgtatattattaagtattctttgaccatggagttagatgcttatactgcaaacaaataaattaatgaataacagtgctgctcatgaacaccaaagtttactgaaaagtcaatatggttttagtgtggtaataagggcagagttctccaaggactgccaacctatttattgtacatcaaattttactgactttgaaatcttgctagaaatgttcatttacctcgtaatgtattatatgtttgaggtcttgagaaaaataacaaaatccatgtgtggtaatgaagtggttatgcaataaaactaacatacactgtgatttgacacaggggacttcactgttatcagatacttaaaactggaaacaatgtaggaaatatagatgtataagcatcgtaagtaaaatccacatgctttaaaaaggaaatccacttacttttaaagtaatattccgagagctatgccactgggggctgaatgtcataaaaatgatttgtaattagtcacttttacattgtatatggatttatagttttaaaatatctggtggcatataaccacaatgtatttttcagtcatatattcatcattattttattaaatttccagagggaaagaaaataaatgacctcctagtgagggatattttaccacgagaccagttgtaaaaataatcgagttttgtgcctgggaagatatctttgctaagtctagttctccagtgacattaatttattgttgttaagaaatgtgtgaggcaaaatgaactctccaaatatttcatactacgtgcattttatccaaaagaagataatggtttacatgaattatttaattggtattactaatttgggggaggtgatttttggttgggggcaacagaatatttgcctaaaatgcattcagagtgcgctgttatttagctattttcaaggtagagggatattggcattggagacttacacgtagccatacaatggccaacttcagtcaactacagaagcaatacagggcagcggctggaacaaaatagctactaggtaaatattgattgaattaattacacggatattaccactagtcctgcaattaattaatacctagccctgtctccagccccagaatccatgacatcaagctaactaacagaaaacatatcaagaattttattccttagtcctcttgactgaccctcaagagggtctaccctcttctactctgtattcctcacatcaaatttcactagtccagccgccaagtaacacctgttctgactgtgctagtgaacttggatattcacacatagcctaaaatgggaaacagagttggaaatgtcatgtataaggacataagcgttttcaaagtgtacaagaacataagcgtttttaggagatttaccttctcttttctgttttattagcgaatgattgattgttttgtatgattgttcatttaacaaatgctatatcatgtaagaaaagttactaacggtatataaagatgtaaaattcaattgtggctgtgtgtatgtgtgagtattctagcttttggggagagacaagagaagaaagaagacataagttggaagagaacagtaaaataaagaaaaaagtaataactgacggtgtctaatgaagtagcccaggtaattaatgctagagtttattagatagaatcattatttccttccagagggattaagcaatcttctctgaggaggtggaacttttattacccaaaacatgaaggattgggaagagttttatatgtgtcgataaggaaaagagatattttattgagggaaaagaagacattttaatggcagagtacacaatgtcagaggaacagaccaaaagaagtgctttgttattaggaagatttgaagaatggaagatagcgtcagattgttaagaaccattttttagataaaggcaggctaaagaagttggaggctattggaaatcagtcacacaattttaagcaagagaatcaatgagtggcagttttgaaaactgaatttgatagtggcaaggaaaatagggctctatcatcccacttactttcaaagttatgaagaaattgtagtaagctccagtcagtacctaaaggaatttattttgtgaaattgtgtaaacaaaaagcaaaccttcttttgcactcatatagtatattttctcaaagtcatatagctaaagggaatgagaggtaaaatagtacagtggttaacaggataggcttcaaagcctaacttcttgggttcaaatcctagcttggttaccatttcacagctatctgaccttgtacaagtcacatgcgtacactgggaacaataatactacctgtattatagagttgttattagatgttgttgatagatatgttgggcacattttaggcactacatacataaacctctttctatagaagtatacatgtgtacctatatttaaaataatgattttcttttttaaaagaagcacatattcattgcagaaaatttttttgaaattttaaaagtaaaatctctggtctaagtgcactaaaatgttttagactttagatatgaactacaaaaacctacctcatcgacacccaaccccactcccagagatatttcattttatttgcttgctatcagtaatgagaagacccaattcaccacacaatttctgttgtatgagactattgtattgcagtgcaagatagtgttttaaatctttgttaaatcaataggtgcaatattacacctccctgtttgaattttcctagtgaagtcaaacaattttaataggcctatacataggtcagttatagttctttcctaaatggtctattcctcattatcctttttaattgagtatttgtctttttttctactgatttgtgagaatgtttttatcttaagagtgtcaaaaagatgaattgtttttgcctttttctttggcttgtttgattttttatgtaaagaaattttatactgctatgaatgtaagtcattactttatggcttttaaattaaaattataagaatagcctcccatattttcattacttttatagttcaatttttttacatgtaacatttcattcatctggtatttagttaggaattgtgtgagataggattttaaaattaagttaaaattcaatcaagtctttattttttaagtacagaagtttccgaattcagcatttacattaaattttttgaaaataatgctaaaatatcatgtaaattattacttattggaattgaaaattccctattattatttttaatctttataacaacttatgttatctatgcttctattataaaataaatgacaagccaaccaaaatagagaagatgcttatcacaattatatcatgataatttaaacatgattttggattaatcataatccaaaaatgcatttgataagcattctaactgttcttctagtccccataaaattaacaaatggcaaacagtaatgttttaattttcaaaatattcatattaatattcattttcaaaatatgtttacttgcatgcatttcatttatattatttcttattgaagttgacttctcaatgtatattgctttaatgatactaagtattaagggtatagattgtactcacacaaataactattgaaaagcataagtttaaatagatccatttatcaaatgatgtctttttttttcttttttttttttttttttttttttttgtgagacggagtctcgctctgtcgcccaggcaggagtgcagtggcgcgatctcggctcactgcaaactccacctcctaagttcacaccattctcctgcctcagcctccagagtagctgggactacaggtgcccaccaccatgcccggctaattttttgtatttttagtagagacggggtttcaccgtgttagccaggatggtctcgatctcctgaccttatgatccgcccgcctcggcctccccaaagtgctgggattacaggcgtgagccaccgcgcccggcccagatgatgtcaattttgaaagatactggaaagtatgttttgggagggaagagggaaggaaagagtagaatatgaagtcagtaaaacctggatatttagtgccatctttgttacttactagtaaccttatgaatattatttatattgttgatccttaatatcctcacttgataattttagaaaatgttatgtacttcataggatcatgggtagaataagaaagtgaatataagtaaaatccatcatgaagtacctgaaatatgttgtaaacctaagttataatagtaattttattgttgctaatatttcagaggaatagccaccaaaccagtactacttattatttatttctatttaacatataaaacatataatattctttctgagtggtaactttgaaaagggacaaaaatattaaaaattacattaaaatcatgtataatttataatactcctttcaaggttactaaagtgtgcatgtatttctaatcattcacaaatatgaaaatctatgtgtaaatttttaaattttctaaaaaattgacaaataaaaattgtattattgtcatggtgtacaatgtgatattgtgaaatatcacatattgtgaaataaacattgcggaatgactaaatcaagctatagaacatattcattaccttacatacttattattttttgtggtaagaacacttaaaatctacttttagtaatttccaagtatacgttattgttactaacagtagtcaccctgagttacaacagataactaggatttattcctcctgtcaaactgaaattgtgtatcttttcatcaatatctcccaaatcaccccacccccaggatctaataaccaccatttttctctgtttctctgagtttgacatttttagatttcacatataagtgaaatcatacagtatttgcctttctttgcctagcttatttcacttgacatcatgtcttccagttcaatccgtgttgttgcaaatgacaggatttctttctttcctaaggctgaatagagttccattgtgtttatataccgcaatttctttaaccgttcatttattgatggacatttaggttgattccatatcttggctattgcaaatagtgccgcagtaaacatgagagggcagatatctcttcaaaatactgatttcagttcttttggatatatgcccagagataagattgctaaatcatatggtagttctatttttaatgttttgtggatcttccatactgttttccacaataattatactaatttacattcccatcaacattgtacaagggttctcttttctccacattctggccaacacttttcttttgtctttttgataatagtcattctaacaggtataagatgatatcttattttggctttgatttgcatttccctgctgattagtgaggttgatcatttttttttttcatatgcttgttagccatttgtatgtttgctttagagaaatatctattcatgtcctttgctgtgtgtcgatactgatatgtaaaatatgcatacaaaatcaaaaccataatttatttttaatatatttttaatatgtcattaatatttttcagtgtaataggatgtttttcataatatttactttaatggacgcaacatatttcattatgtaaaagcagtttattctatttggggagatttcgtttcactttttcgccagagtgacataattgaacattcttgtcataggtctctgtgtttatctctgatattcccctaggaaaattcatagaagtagcattttggagttgaagggaatgagtaatcttaaggcttttaaagtagttttatcaaattttctaaactgaagtataaagacacatagaaaagtacacaaatcataagaatagaaattcagggatttttaaaaaaaacttagtgtatccatgctactaccaccaagttcaagaattagaacattacctcaggagcccctctcatgttccctcccagttatgagcctctcccctgccaccaccctctcccaaagataagcactcttttgacttctaacacctagattagttttgactttgaaattactataaacagaatcatccagtatatgcccttgtatttgacatgtcctgctcaacattatttttgtgatattattctatgctattgcctgtgccatagttagtttagtttttctatgtatggtattctattgtgtgaatatgccacagtttatccattctgctaatcaatggacattgggctgtgtctattatggggctattaggaaaaatgctggtgtgatgttcctgtcctttgctgcatatatgtatatatttatttttaatatacgtggaagtacaatggctaggtcataagatgtgtacatttggctttggaatcaccaaaaaacagtttttcagtgtggtcatttcagttcattttcaccagcagtatataagacttctagttgatccacatattcatcaagagtatgtattttcaacctttatccttttaaccatttaggtgaatgtgaaatggtatttcattgtgttttaatttgcaatcacctgacgattagtgccatttttatatcctcttatgtgaagtcattatgcaaatcttttgcccattaaaaataatagttgtctttttcttactgatgtagaagttatttggatacaagtcctttgtcagatctatgcattgcgaatatctttttccaacctaaactttgctttatttttttctcttaacaatctttcctgataaatggagtttgatttatcagtcttttcctttatggctaatgctttttatgtcttgtttaaaaaataatacattaacctaaaattgttgagatttttttctatattttcttttgaaaactttatttttttgccttttacattgaggtctgcaaacaatctagaatttatgttttgtgtatgatgtggagagtcaaggttcatgtttttcaaatgactaatcagttaacttggtgctatttactgaaaagatcatccttttccaacttaagtgacaccatcgtataaattaggaaacgctatatagatgatttgttctcacttcaatcccacacaggcttaattataataaatattcatgtctggtggcaaacattcttaaacttcgtcgttcttcaaagttgccttggatattcttagccctttgcacttacatataaatcttaggattggcatgtcaatttctactaagaaatggttgctgcaattttgattgagattgcattgaatttatagattatttgaagagagggcagatatctttacagtattggactttctaattcatgaagaaggtagtcctctatttgtttacattttcttcactgtctcagtagtgtttgtagtttccagggtagaagcttaacttttcggtctgaattaccaaattactagcaacatatatagtcatgcatttcttaacaaatgagatatgttctgaaaaatgtgtcattaggtgattttgttgttgtataatcatagagtgtacttacacaaagatagatggtatagcctactgcacatccaggctatatggtacagcatattgctcctaggctacaaacctgtactgcatgtgactttactgaatactgtagtcaattgtcacacaacaatatttgtgtatctagacacagaaaatgtaccgtaaaaatacagtatacaaatgataaaaaatagtacagctgcatacggtatttaccatgaatggagcttgcaggactcaaagttgctctgggtgagtcggtgagtgagtggtagtggtgagcaaatgtgaaatctaagacattattgtacggtaccatacagtttacaaacactgtatagttaggctgcactaaatttatgaggacacatttttatcttttttttttttttttgtatttttagtagagatggggtttcaccgtgttagccaggatggtcccgatctcctgaccttgtgatccacccgcctcggcctcccaaagtgctgggattacaggcgtgagccaccgcgcctggcccatttattttcattaatgataagttaaccttagcttatagtaacttttttactttataaactttttttttaagtttttgactctgtaataacacttagcttaaaacatgaacacgttgaacacccgtacaaaaatattttatatccttattgtagcagctttcttatttttaatatttttgctgtttaagcttttctgttaaaaagtaaaacacaaacacgcacatgagcctaggcctacatgggtcaggatcatcaatatcactgtcttccacttccacatgctgtcccccactggaaggtcttcatgggcaatgaaacattcatgaaactatcatctcataggataacaatgccttcttttgaactaattaagaatatagtaaatacataaaccaataacagttgtttattatcattatcaagtattgcatactgtacatacttgtctgtgctgtatttttatataactggcagtgcagtaggtttgcttacaccagcatcaccacaaacgtgagagtaattcattgcactgtgacatcactaggtaataggaatttttcagctccattgtaatctcataggatcacagtcagtctgttgactgaaatgtggtgaatgactgtataatagggctccaaggaagatcataaaattgcttgttttccagaactttgacaaagaccttttacagaaactaatataatagataaataatagtataacattgctgttttcctttgcatttcattgattactaactgtctggattttttcttgtttattggctgtttacatttttgtcaatttctttttatgttctttatccagttttccagtagatttttcctttttttactcattaaaagatttttttatatgctaaaattattaccctgtgtctgatatatgctgcaaatattcccagttgtcatttgttttaattttgattagtggctttaatttataagtgaatacgcatattatattcaatctttttatattctttttttgcttctaaaaggcttccccacgccaatattttattccagttcttcttactatttttatgcttaacactttaatttttctaaaatgttttgtgttatgaaatccatcttaatatgtttatttctaaaacagacacttttgcttatcttaatattaaaacatatacatttgaaattaacattcagagattgaaagaataaggaaagtaatcttgtgtgaaattaggtcaagatgtgcttagatactaaattaacacataagggaattgaatgtgtttgttttctttcaccacagggaacatgttatatgaagagcatggttttataatacataaaaggattattagaaaaatgatgtattttaccggtcaggtgtttgtgtctatactttgatgtgaatgcaaaatagtaaatataaatgtaaattaatttaaaacacatagaatctgatacaaaccttaatctttttccacgttatacattactcacacctgttatatttttccgtgaagtatttggaatactctcgattcctggaaactgttttaaagtgcagaagagcacaaaaaaaatatgtgttaaaagttcttgatttccacccaaccattaagtgatattgccaaagaaaactcttcagagcatttttcactgatggctttagatatgttataccagaataataatgattcattattaaaatatgcaaagtgtaatttctcaacaacattttgtggtaggaagatgagctggtacagtagttttccttattaaataattttttacaaaagtaattgacatggtttggctgtgtccccacccaaatctcaccttgaattatggtaatccccacatgtcaagggtggagccaggtgcagataattgaatcatggaagaggatcccccatactgttctcctgataatcagtaagtttcacaagatctgatagttttataaatgtgagttcccctgagcaagctctcttccctgctgccatgtagaatgtgtttttgcttctcctttgccttctgccatgattgtgaggcccccccccgccatgtagaatggtgagtccattaaacctctttcctttataaatcacccagtctcagatatgtctttgttaacagtgtgagagcagactaatacagtaatgcatttacattgttcaaaatataaaaggtacagtaaaaaatatctcaccctacccatcatctgctctaccctcactgcacattaaccttaattctagaaacaaatctacaaaataaattcctgggaataaaatttccaggtcaaagtttacatgctttttatagatatggccaaactgccttccacaagaggtacacaaatgtatacttcccaccagccacgtagaagagtctgcattttcccacagccttggcagcatagtgtacctgcagacttgaatttttgccagtgcaatagatgaagctctaattttcatttctctcattattaccaaggctaagcttctgttcatgcttttaaaatcctttgtattttcttttctgtgaactgtccttatcttttgtccaattttcttttgggttgttggcctttttcttattactttgcagaaggtctttcatgtgttaggaaaattagtcccttagacatgagtcacaagcatttatttttcataattgttcatttgtttttgattttgcctatggctcttttggtcgtgcagaagcttttgattttttatatagtccagtttactgatatttttgtctgttaattaaagttatttaacttgaggatacaatttacatttttttgtggttgactactatagacatatactgcttcttacattgaaaaaataataatcctgaatttggaaattgtttttaacaaacttttggtgaaggtccatcatatttaggaacagagcttgtttgacccagaaatcaaaggtcagtgagaaggagcaatgtaaatagaaagttaaatagcatgaggtaaatgttatgatggtgggaaagacaagatctgagaggataaacctaaagcaacatcataattaagctgaaaatttcgtctcatgataagctatcatttcattattccagatattagtcaaatctgacccattacactgttttctgtcaggaattgttttacctctattacaaggaagggatagtatgggaggatgataaggaaaccagcagtcttagttaaatgttatacagatttctgtgcttatatatgaagcctaaatgaaacgtgaacaatttcatgatcagataaaaaggagttcatcgctcagttttagagattttaggaaaatatgatggctattatctcagtagcttcagagtctagaggcatttagatgttgttagttgaagctgtaaaacgctttttacatctacttgtgagtagaaaatgatccaataaaaataaaatgtttagttacctcctttaaaatgcttgaaaaataagttgaggacatcattagatcatgtattacagacgtaggagtatatttgtaacatcacctacatcacacatacctgtgtgcgcgcgtgcgtgcacacacacacacacacacacacacacaagagttcagcaccacaggtgtagttatggatgtgaactcacaaaacacaaatcaagcaaagagaacaatatctcaattcatgattcatggacattctgtgctatctgaaacacaatgcttcttttgcccaactctcacccacacagggaaaggctgccaggaatgagaggcaagaagtgtgcaggtcaccttcaacaggagccaccacctgtatttcccatcagtcttttacaccattgtagtcacgtggatccaaggactgtattccaactgacagctcctgcgatgaggtgcagttccacacgacaaagccaggcccaacatttcccattcatcttaaagttagtgtttccaaggaaacagtgctgtgggagcctagggtcagtcccagactgacctgcaacagcccaggctggatgttaatcctttgcttatacagtctcatgaatttttcacaacatatatacatgcatttacaagacgtttcactgtacatattgtttacgtatacaatcttgtttaaaattcatttttctgtacattaattgatttttttctcgacaactttctctttttcatctcctaactcttgcatccaattaaacaatgtactgttcattagtgacttattttaaaagtatctaaaacaattgttccaaagcatgtgacattgtttatgtgacacactggtatattatctagtttatttttaaaatcttctctattattattcataatatattattatggaacagatgtatattataaaattttattcatattgcagtgtaatattttgtattacagtggtattgttaatagtctcgtaaagagctatcattacaagtttaaattctttattctgggatgccagttttaactcttgatattctgaagaaaatagctttactcttgtttattctggctctgtttttttgttttgttttgttttgttttttgttttttttgttttttttttgtagagatgggagtgttgctatgttgtccaggctggcctcgaactcctgggctcaagcaatcctcctgcctcagcctcccaaagtgctgggattacaggcaagagctacagtgctcagcctatcctggctctttatttacatgtaagcttgagcaataatcactgctacttaataactttattgtcattcattatcatgcagagtattgctctaaggtatgttcagggatgacgttactgagtcctaacagtaatcctatgaagcaggtgctatcattgtccccaatctacagaggaggcattgagagttagagaaaacttggctaaaatgttaggcaagaactagaaccagaattgaaatccaagtggcctaactctagacctcacaatgcttaataccatgtcatgctgcttcctaacctatttaatgtttttttcaaccccaacgtcatcacccatgtgtgatagtgggatcataataatatctatgtcgtagcattgttggatggattaaggaagtctacaaatgtgaaacttccaaggatgatggttggcatatactgatctcttaataaaaataacctataatcattctgttacagtctactctaatccaaatgttctttttacttctcatctcaaccacctgcttctgtttactaggactcacaaactatagctcacaaaaacgcataacttaccaattttccttgtacatgaagggacttccttttacaatcttccatgacataaaagaaagctagaagcaagtatagtagaagaaatgattgctatacaaacaaaattatagttggtttggttttaattttaggatgcgcattgaataaaaatcactcatttgggatttagaagacctgtgttatatatctggtgctaatgctgaataacttggcttattcatttttataactgcaaaggaagcgcgtatggcatataatacacaacacaccagtatatttagtaactgagtgaataaatgaaagatgtatttctttactttatcagttgcagttggctatgcctttgtgtaaggtgtgtgttttgaaattccaaaaaggtattagtttctttaaagcaaagaatttttgtagcaggttaatgaataattttgaatacattggttaaatcccaacatgtaatatatgtaaataatcaatattatgctgctaaaataacacaaatcagtaagattctgtaatatttcatgataaataacttttgaaaatatatttttaaacattttggcttatgccttgagaattatttacctttttaaaatgtattttcctttcaggtttccagagctttacctgagaaacaaggagaaattgaagctcaaataaaagaccttgggcagcttgaaaaaaagcttgaagaccttgaagagcagttaaatcatctgctgctgtggttatctcctattaggaatcagttggaaatttataaccaaccaaaccaagaaggaccatttgacgttaaggtagggaactttttgctttaaatatttttgtcttttttaagaaaaatggcaatatcactgaattttctcatttggtatcattattaaagacaaaatattacttgttaaagtgtggtaaggaagactttattcaggataaccacaataggcacagggaccactgcaatggagtattacaggaggttggatagagagagattgggctcaactctaaatacagcacagtggaagtaggaatttatagccaaggagcagtgtaggagtcagtagatggaaaattattaagaggaaacatcaggggtaagtgggattctggctaaaccaacctcacaggattcttgctgaagataggccagggttatcttatcagacaacccttggggaatggtggagaatactgagggtgatcaggtaccaaggataaagggttcttgtaaaactgacaggcttctttgctgaacctggattttacaggggagtgcaaagatgagcccaggcgaaggttcagaagcctgactaaagtttagtcaagcagggaatctttgtcatcatcatcattgttgtcataatgataataattattattattttactagaatatgttgctttttcctcagcatttactagaaataaggtcttcattaaacttatgttactagaatgcctgcatcatatttgttactgtgattcattttctatccctgttttaattgtgcttaatacatattcatagattccttatccaaaattgaagttgtttatgagattaggttcctaaaatataatgtctgggctcttttgtagacattgtaaagccctctcagactgactacactttacctttctatcttctcattctgccagcaatctccccgtatagtctggccacatcaaattacctggtacctttccatccatgtaatttcatgtcatacctgtgatcttggttttctctcttctttaaatgacttctttcagtttattttgatataatgaattttcttccattctttaagaatgaattcaaagtcattgcgtcttccaagttttcttccgtaccccaagtagagttagaatccctgttaggatttcttataaacctttttattcatctcccattgttcatatgttgatttacacttaaattttatacacctgagtatttcattacacatctgcactgttctttgagtgcagagggcattctcttatttatctctgcttctccactcatatcatacacactcagcctaggatccagtaaatgatgcttacttgtgagtgtttttaagtcaatgaataaagacagtaccaagacacccagaatacgaatgagatactgcaggtaagcgtaaggcttcagacaatcctgccaattgaacaccactatctccttcttctagtgtccttgtaaatgctgattgatcttcttttctccctttcaaggaatctattccaaagattctttcaatatgctgccccgttttgcgtctccttatttgccaaaatctttaagtagccaatcaaataaaccgaatcgttgaaattacaatctattaatgaatgtattgttgggcaacttcagagtaaaaaggataagtaacatttttgagtagttttttcttttatttaattgactttaattgttaaatttatttactgtccagtattgtaaaaacctaacattttaatctccatttagctgttgttttgctggaactgagagcaaagggaaaaggaagtttgagaatattctagtgaagaggaagtaaaagtttcgggaagatgggcatgagtaacaaggagatagagggaagtttgctacaactaaaatgagttagattagcaaaatgttctcgactatgtttaccttacttcctcctgacacttatgtctaccattctgatagctactcctcaagagcagatggcactgtggaagtcacaagtagacatcatttcactagcacaaaactcagcctgctcagccagtggcacagtcttgggttcagtctgatgattaaatttacgagacataataggctttacccagtaacaaatttagttagctttaagaaattatacaggatgggtaacaacagcctgcacattaaaggcacagtggaagtcttgataccaagacgtggcttctgatgtcccatcaccctgaattttagtcatacatgatcacaaggggcaagactgggtgcgtacaaaacacatcatcgtctcagggaagccatcagttctaggatcctgaccatttctccacttagctagtacatattgtactcagaggtgtttgactagctcctattcaccagtacaattacatctcatgaatactgatttttcactgctcaataaacaaccccaacaagaaagtacagttacttggcccaatacacaataaccttagccaaattctcaattatcttatatccagtatattcttaaaaagtaactggcgtaatattgcgaagaggaaaggtcataaagtctttcctcccaaccagaaatagctttttgtagctcacggtaaaagcacattctactcttttaaatgcaatctttggttaaaatgtgcctctttattataatagtttaaaaaatactcaatgctagctatctctcttcctggaacacatttaagaaaagatttttttttgaatcccttggtacaaatagatcctgtttactcaatcaaaatgacttttgtcccagtctgtgccccccggaatggttttcaaataatgaaaacctgcattgtgtcttcgattgtctatggcccatagggctctgccaaatgggtccctgcagtttgaagtgaaagccatactcggctgtgttaatcacttttctttatcaaagctacaagtcaccactcactgctgtgtgtagtttctgagagtcatgatatttgcctcctgcagcttgttttaaatcactgaggggagagggagctgcttttttcctggcagaaaactccttggcttcagtcctctgagcacattccgagtttcttatctctggagtgcagacttcaaaaatactcttttagcctttttcttctgcttgtggctgtgttcaaggtggggggaggggaaacataaaatcatagatttgatgacttgagagtttctcccaaaaattctcaaacccccagcttataattaggaaatggtgacctgtgtgaataataatttaccttgttttttatccctctttgtctagcttccattcctttcactaataaatgatttattaagattgcacagtttttctgatttaagatataggatattagtccttacagcctgctgtattcctctgcttaaaggaattaaactatttttccattaaagaaagatgggacactagactttgctttacttagtttcaaactactgaacaccaaaaataaaatttttaaggagttttgagcacatgcccttttttttaacacaaggtaaaaaaaaaaaaacacctttactaaaatcttaagaaagagttaatgcaaaggaagtagatatacgaacagccacgcccctagctccaaatcctaaatgtaaagaaacttgccttgtctggccatggtggccatagctgcctcggaaacaaagggtctgaggccttgccattcgggtagtttgttttctctagtcaaactctgagcacacctgttagaaaaatatgtaataccctctctctgtgagcctcagttttgtctgcttggtacttcactcttattgatgaaatgcagctagctgtgtagtgaaacccagataaaaaaaagctttaagggctgtgttctaatacattgtttatgctggagtgaaaattgactgcacattgcttggtttgtgcaatttactcccgaaatattcctattcaggaaatcctgcaaatagcaatattcatcttgaaaatcacctcacagaacccttagcaagctgagaaacataatcaatgagatcgtgatgtagagggtgaaaattaggcgtaatcacagccctttcccatcagtcagcccactagaaggcatgcctttgaattttgattttcaaatatactctcaatttagacataaaatatgttgatttcagatttcagaaatgataattgaatgctaagatcccgggaccagtttagaatttctataaagggtcttatgtttttaacctttaatgaatgctttcaataatgagctagaggtatactatttatctgacataagactgactactgctttccaaactttttattaaaatatgaggtgtggcgggacacataattttatgttaaggcttagtgactgaaatactttcatcttaatcacagggagggggttttttcctcccctcaagaatcactttccttctgtggtttataaataaacatgacatgtggctctgctggctcttccttgcagtataaggagcataattgcccataatgtcaaatccacactaaaaactaccaaaggactcaattgtagtgactgaccattaaagtcactgaacactgtgtgtgttcacattgctgtgagtgttgtcaaagaaaaatagcactagacaacagacaagaaagactgtgttcaaaacttttgcaatagaggagacagattgaactcaattctgctgaaataaaaggcaggagagcctctaagtgctgagatgagttagtgagaaagtactagatatcaggagggaggttagtcaatgtgcttatttaggccatctgtgtttgctgattggcacttatcaaagttagattcctatcctcccaacagaagactagcagattggggcactatcttttttgatgattctatatcaaagtgctagctcccaagtccttgagaaagtttattcctgaggtataaaagtggcaagaggctaggagaatatttttgtctcaaaaaagtagagaaataatatataaagttttctagagtaaatgctctaagaaaaggaaggtcaggtctaaagtcaggaagaaatctgtctcaaatgtagtcaaactcagggtatttttaaagctttctttgtcaaccctccattttgttcaagggaaaccagttttcccattgaaaaacttaggaacgccagttcatctagttcatttcagcaggtttctgttgttgaaggactagctgaacgaactctgacacttggtagtaatcagacatttcatgaaggagatttccatgaaagttagaaggaagacgaagattaatggttgaagcagactgcaaactcagtttttgagtccagagggcagcaagtcaaaaagattcctagaagctgggctgtaggcattctcagatggtagagtgaggatggcagtagcaatccgatggatttcttggagcatggcacggaagaggttggagtttactgaactttttgcatggcctacaaagcagcagctccaggcatgaaagttgtctatacataatttgctgtggtggtgagtcctttgtagtttatagcaagtcatccagcttctgcttgcagggcttctttagatattgtggggaaatggcagctataagacaacctagagaagagagtccttatctcagtaataatatgggcagtcacgttttagttctcagtgtcaccaagtcaggatggtgggagaaaaatttgaaatgttaatttggagaatcgcagccagattgtaaaggaaataaactgaaaattggtaaggacggacaaaatgtgtaagacagcaggatccagatcaatttacaggtaggtaaaaaaaaaaaaaaaaaaatcatgtcgtttacaaagaaatgcaaaatagatcaaagacaatgaacaggactagaatctgataaccccaagggttactgaaactctatctctaccatcacccttttgatcagtgttaatcaaagtaagactttccttgtttataaaataagactggcctatttatttatataggggtagcaaaaatggtaatttaccaaataggctattttaagtgtgattagctggaagttttcatgaagaatcacaagctgaataagtttcagagatatactgtacagcatagtgcctatagttaacgatactgtactgtacaattagaaatttgctgagggcagagtttaagtgttcttaccacaaaatactactactctcttttaggagcagtggtacataaggtgagaggaaacttttggaggtaacgcataggtttatggcatagattgtggtattggttttgtatatatactttatctccaaactcatcaagttctatgcattaaatatgtacagctttctgtttgtcaatcatacctcaataaagtagtttaaaaaatatgaaacctcagatttgattttttaaaagtctccaaagtttaggaaggcaagtcaagaacttgacatcagattttacctgaagtaaaatacctatagattcagctgaagtgttctgttttccaggttcctaaaatacccttggtttcctgggtctcctaagaatagaccttccttactcagttgtaagattgggaattctgtaagccaggtaccgggacagttttcccaaaaggggcttatattagctccatatagtcaagagtagctccttaaaactggtcacatctgactctatgcacttaattctcaaatatgacattccagtcaaagccttggttatatatttttttcaattatgtcttgttacctaaatatatttattgagcctatgcaaataattatattgccatgaaaataagaatactcggtaagaatttctgaattttacagggatcaggcagggataaaaagattaatgtttcattctgtttacaaaagcatactctaaattctcatgagttatagataacttaagagaaaaaggaaaggcgtttcttgtatttagcaaacagaacattaaaacatgaggaatattttaaacaaaagccataatcaaatcttttatcagttcattcaggcccatgtagttaattcttgtcttgcttgatcttgagttagtagtttcatgaactcatcagcttcttcacagagtttcataaatcctgactttgtccaatggtataatctcgaagttatttaagcaatggcatcagaagtctgtgtcccagagtacctgtcgtagtacttcctatgggtctcaaagatggtcctgttttactgaagatgatgcattctgacctctaactgattgtaagagcactcagggaagcatcagcataaaccaaaaactatctgtgaacgacaaaagacttaaaatggccataattaaagatctgattcattcgacaagaaattttttttttccctggtgccatgccacattttaaaataacaactggagttaggactgatgacataatattattatcggataaagtagcaccaggatgtgtcatggacacctagagcacctagagcactaacaaagttctaaggatttattataatttttcaagtatttatactaataatagttgacccatacaactataacctagtcaaggttcagcatctcttcttgtcaaagctttttatgcaactcaacataccaaatgaacctagttatttttaacatccttcattttacaagggtgcaggaacaaatcctttgaaatttttcaaaccaatctgagattaaaaaaaattttatttaagaattgacctgggaaaagcaaaatatcaaaggttgtaaaatgacaaaaggtttgaatacttggctgaataggatcattgctcactatgaaagaatgcatggctacctatgtaaccaagatgacaataaaagatttcaaaaataaatgtagaaggccacatgacggtaaaagtttttagttctttccaaagagaaaacactactttctaaaaaaattcaaggacatacaaaatcaacacaggtacttattctgataagaaacaatatttgtttcctatacagattacccaaaatataaaaaaaaaaacaaattttgcaatctcttattaagagaagaccaatagaaaagatgaaaatgttaattagtttgaccgaaataattgttttgcaattttgtgtgtgcgtatatatatatatatatatcaaaatatgttgcatacttaagtatattcaattttatttcaaaagagcagaccaataatccaagaatattttatcattttttaacaaaaagaaactacaactcatttttgatcaatacactgttgatactaagggtcatttgtaagagtttacatacacataaatccattccgttttagccagcattggctattaacataagactctccttccacaaatcttctgccatttccaatgttcattcagattttgtcctataccttcctcttcctcattttcacagtcattttaatttaggacaaagttattctctttttccttaacaaaaacacatccaacataccttgtatattttgcatacaaagttgtttccctttacccctaatgtttctggaagttttatttacatatattgattatatttttaaccattagtaagtcttattttatagagaaaactaggaattagctaagtgtgaactgtttgtcatataccagtatttcatagccaactagcaaagcttatgaatacaagttaaattcacctactcaatatgagggctaaaagtttacatcaatatttgtggaggagccttttaagattttcttttgccctgatatgtaatttatggaggctgtgttctaaaatttgagtaaatgactgaggagatacctagtggccatctgggtatctccaaatcccatctgaacgtacacggtatccagtctgtttccaattagctttttcaacctcaggtggttgcttctggggtttgagttttccagagcccccagtagtggcagggagcataacgctttagagaccatagagagttgagagactggagtaggaagagaaaggtctgtcatggatggacaaagagatggagcaggtacgggtttgaagaggaatatgctgaaggatttaagggagctaaagggaagatcaaaagtagtcaaaggaagaaggaggaatggtggtgatgggaagggagaggtcttagatgagccagcttagggagtgcttatgttttcggaagaggccattgaagttcatctttagtaaaaatcaaactaacaagaagagaagcctagtttgtgccatagaggtgaagcatctaatcagcagtagtcttcagaggaggagaaacagaatagtgagaatgtctcctggaggaaagaggcaccgaaggaacagcaacaacaaaaaaaggaaacatgaatgaggtctctacaaacgtgatctgtacagaaaatgatttctctaaatactgaaaatctgaagttgaaccaaatgagatttcaataagaattttccatgttctaaaccaatgatgcttttcaaacaaagaagcctgggactctagactcaagaatatactcagattactgagaatcaaaatctgatgttaccatgcttccacgctttcgtgggtaaggagtcagacttaccaatggattcccaattaatcagtcaggagtgtactcaacattcacaaaattagctttgcagaggttaatgtcattaaattcactttagaatggataattcaaattcaaatagtaactcccttagatagatgtgtactagctcaagttcacctgttatctgatttcatttttaaaaaaaattttttaaaagtggtgttcgggaggtaaggaacaaggaagagacctttagaaaaaagtttcagtgttttatattggatatgaaaatatcagtggaatgtgtcctgaaaaacactggatgacagttactggacaaaaagacaaattattcccttttaccatgcaactgaacacagatttattgaatgtttttctcctgagtttaggttgcctctgggcaagagtataattctggcttgataacaccttgaagcgtgtttgtttaagtttgtggatagtttcatctattagtggaattaggcatctgcttctctttatgaacactgggtaccataatcttcctcttactttttgttttttctactcaactccaaaaaccattgctgagttgaagtagaataataaggggaaagaaacaaaagactaagtttgaatcccagtgctgacacttactggctttacgatattgtttaactcacttaccctttttaacctgaccttcttcttcactaaaaatgaaaaattgagtgaatttccctgggactctgttagataaggcaaaactaagatgggaacacatttcctaaggcgtagaaaaagacagtgaatgggacctttcttgttgtatcaggagttatggtaagaggtactaacaataaaaattaggctttcagccaggcatggtagctcacgtctgtaaccctaggactttgggaggccaaagcaggtggattgcctgagcttgggagtttgagatcagcctgggcaatatagcaaaaccccatctctactaaaaatagaaaaaattagccaggcatggtggcacgcacctgtagtcccagctacctgggaggctgaggcatgagaattgcttgaacccaggaggcggaggttgcagtgagccaagatcacaccactgcactccggcatggggaatagagcaagacttctttaaaaaaaaaaaaaaaaaaaaaaaaggccttcaaaatacccctacagcagcaagttggtaccagaaaaacactccaaaaaagggagtagatggtcatgagattttcatcgttcaccaacctaacttgcccatataaggaaaaggataaacttgagaacagtttcttgaatgagaattcctggaacagatcattcaaataggactaacaatttgttggacatgagaaaacttctatgacttttactgttccctttcttatgagggaggggagaagagtgcttttcctctttgccaagccaaggaagagggcttcaaagaacctctattatagtggcattcagaccattgtatttataaaaaataaaaatattttagaaaattgaatatctgcttgcacattttaaagatgacatctattttctgcccttgggatacagtaaatattgacattttaaaagggtttatagtacagtttagaatgtatcccgtggaatccaaataccattgcaatataatgtctaccatcatatacttaaaaatacatgaaaaagctcatatttaataaatagaagttttatattattcctttttatttaaatcatatttttcaacttccccaatgaattgtattctaatgtgataaatatgtgatacatatttatgctataaagttttattagccactctatcataattctttataaaattatatttatgtggacttaaattcaatttttaaaaacaatttcctgtgactacaaggctctaagtatttttaaaattctctagattgagtagtatttaaagtattaataataaatacacttagtaataaccaaataacctaaatatatgtaccttttgataaataattattaaacatactcagtggatagttattgaaaatgaatctattatgagatggatgggtatttgatggtaccttgagtaaagaaggatttcagtcgctaatattttgaattgtacttttatttggcataaatgtatcttgactacaatgcaccagtgggataggtcagagaggtgtgcttttattttgtaaagcggaagaaagtctgtcattaaccaaaaagtgggcaagaaaattggaatgaagtgcctaccacaggaacaaatccagtcaaatcttttttttgtttgtttgtttgagacggagtcttgctcagtcgcccaggctggagtgcagtggcgtgatctcagctcactgcaagctccgcctcctgggttcacgccattctcctgcgtcatcctcccgagcagctgggactacaggcgcccgccaccacgcccggctaattttgtgtatttttagtagaggcggggtttcaccatgttagccaggatggtctcgatctcctgacctcatgatctgcccgcctcggcctcccagagtgctgggattacaggcgtgagccacctcacccggccgcaacatgctgttttaatgagcgcctgggtgcgggcagcctcaggcctaaaatggcgttagccccaagtgaggactggacaaaggttttatagtctcctgtaaacaggaagtctcctggcctgacgtaactgctgcattgtacccggatggcctctttctcgatcttcagaggtacttgtcttctggccggctctcttcctgcttctgctatttcgccggtgcatgctgctcaggcaagtagccttgtgccttaggaatgggcctgagaaaggaggagttactcatctccttaagctttcaggcccgggagagaatcttacaacccactgatgagttatgaaatccatttaatgggtaaaataaaatagaataagatagcatagggtaccaaagaatataacgcaggttattacattgtgttacgtgtggtatgcttaagtgttgttttctggaactgttgttatcatttgtattgtacttcatttttgtttcgaattttaagataatctgcacagttttatagaaaatgagttaattagtactgtatcagtgatgtcatactgggttaattattacaaagttgggggtaaatttatccctgtataacagactttaaagataatataaataggccaggcgcaatggctcacacctgtactcccagcactttgggaggctgaggcaggtggatcacgaggtcaggagttccagaccagcctggccaaggtgatgaaaccccgtctccactaaaaatacaaaaattagctgggcatggtggtgagtgcctctaatcccagctactcgggaggctgaggcaggagaatcccttgaacctggaggcggaggttgcagtgagccgagattgcaccactgcactctagcctgggtgacagagcaagactccatctttaataataataataataattttgtttatttattgaatagatactttcttccagtacaaaattcaaaagcattgaaatcctctgttgcattgttgtctttcagccacacagtttctctccccatgtgctgccaaggttttcagtttcctgggtagccttccaagaataggatgtaggtgtgtgtgtgtgtgtgtgtgtgtgtgtgtatattattttctactcttgtcctcttaaaataaagccagctgttagaatactataaatactgtttctgcatccttcaaaagatggttcttttgaagcccttttccttggcttggcgagggcagaaggaaaagcactcttcttcctccttcataagaaaggaaagactaaaatgcctgtgtgtgtgtgtgtgtgtgtgtgtgtgtgtgtgtatagcactcttctccctcccttataagaaagggaagagtaaaatgctgtgtgtgtgtgtgtatatatatacacacacacacacacacacacacacacaggtgattattttctgtattagtagttaaagaactgtctctttttttttttttttacagttgcatactattctgttctaaggatataccataattcacttaagcagcactccaattagtgagcctttagtttgtttcgacttttggctaagataagaaaatgtataactttgtgcacatcattttacacgttgcaaatatatctatgtgataaattcctagccgtcgaatggctgcgtcaaactggcatttgtcttgttagtacattttgccaaattgctcttcatagaacatctcgtcagtattaggaaaggtttcttttccccatacccgtgcccactcagtgtgttatcaacctttttgatcttctaaacaagaaaaatggtgatatctgtcattttaatttgaattctttattcattttgtgagtgaatttgaattttttcatgtgttgcagaatcatttttatttccttttctatgcactgtttgctacttttttgttttttgccaatgttctcttttgggttattggtctctttcttactaaggcaaatatagtttacaacttgaagtaaaaacatggttttctatgataaaggttttaatgaatgttttctacaacagacagattctagtcttaaggttataacctgaaaacatcaaaactaacctttgaattgcataggaatggtctttgctcttcttagccatcaatcctggacagaagttcaacatgatgacaaattgtagcacaagtagagatttaaaaaatttttaactaatatgtaaatatttgctttcattttcttatttatctaacaatacattgatggctagaacagggtttgtctttgcaaagagcctgtgtcaactgactcccattctttcaaaatacattacctaaagaaggtttgtggcttctctttgcattgcattttctagccaaatctgaaataactatctggaagcttaacattttattcccacacttatttttccttgtgaaaatcaaaactgcactttcccagtcttcatgagtaaccacaatggtttgccatttgacttgccagttgtattagcatactgagatgtaatttatctgcatcaagagagttaattctgagcagctgggggctttctaatctctttacccatcttggacaccagttccctctcactgctatttgttttattctttgcagttagaataccattcctcttgacatacaagaaacaaacccaatagaaattaaaaggttccaatttctattttccattcaccaatattataccattttctcctaaagcagttctactctctcctagatcattctcttgcttttgaaataaaccttaaaaagtcattttgtcaccctaaatatgtttatactttcttgaaataatgcttttactgcatattagaattttagtttttacttagcagtccttcactactcctttagaaggaaatttagataatactttgaaggaagttatgagagaacgtcagaagccatgctatcagttttttttttttatgtactctaaagaaaactctgctctgcccatgggtgtcatctctttctgattctgtgtggaggagaaaaatgggaacacttccaatcattttcaaacaatttctgcttaagtggatgaatggaccacctggtttactaactataatgcccaggggatggctttgattggcagacagaacgcggtgcagaaacaatggaagttaaatgaggaaggttttaaacttgcaagttacctcccttggtggcattgactgttggtagaaaataacacgttgggatttcagatacattcagacatgctctgcacttgcaatttgcaatacttaaaacaacacaattcttctaatcataactttttaaaaaatttggccacctttctccattgtctcataaagctatattcatgaagctgtttattcacaaagtcgtatcatttaaagataagtgttatatccataagtatgtaaatgaattaaaatctgggaggctaacacttatccattccttattctactatatcctatctagagccatgcttcttaaaatttaatgtgaaactgttatttctggtctgtggaaccacagtttgaaaagcactgtcatagattcttaagtagatacattttcatgcatacaataaatatgcaggagaagttaaatgggtatgtccgggagtcaaatattgattctcagaatgaaaacttcttcatttatttctcagtgatcttcataaccctttcccatactgggcagtgagaaaaaattatcatctcactctgaaatagtgatttcaccagtctctttttatgggttgggacctcatggataatgaccagtcttttagatttccttgctctcctcctgctcctctccaaaatggcagctgggttgacagatgaggaagcattatacatgacctgagatctctatgcaggtacttgcagtctcctctgaccctctgctctctggaacagtgcctcttgtctgcctgataagtctctaccctgctgaccttgtggctctgagcttgtattttcatcaggaaatacggttctctgctgactatatcagttactaaagggattcttaaatctctgagttactgctgaagaacacttagaattctaaatttgtaattatgatacctctaaaaacaagcgtgattatccattatgtataaggatgccttccaaaaagttggagcaacttgaagccacttgttacattgtcatttagtggaggagggagtgaacttggtgtttacaggtagaactctctatcaggtgctgtgaggaaaaacaaaagcaagataaactgtggccataatctttgttactttatttcccaatggggagaaaaagacaaatatatatatttgtcaaaactgaacagatgttatttgaacattatactgtatatgccattataactataatgtatataatacatatatataaattattgaacactaaaaagaacactttaagaattatctattttattttttttattatactttaagttttagcattaggagaagtatctattttaaataaagctatttcactcttcagtttccatctcaagaactcataccaatttaaacttccactcatatttgagagttgagaaaaattaccaaatgataataatatattatctaaaaaataatttaaagatgcatgtctctaacaaaactatgtaacattctgaagggttttaagtaatacttcatatatcctaattcagaataaacttagatgttatcagtatgaaaatatatcataaagtaacatgattctctccaatgaagatgtaatcatccaaactttatgcgttgaatttacggcttagaaatgccatagcaatatgtcctcttgaatatacaattctatatactgagatttcacttagtatattaagttctgtatcactgaagagtatattatgattctaattaacaaatacaattctattttatataagtacccctatcatctactaggcaaagttagctgatgttactatgcatttttttgtcagctgtactcaacttataataactttgtattccaaatacttcaaaattgccatatgcttactgttttcctattcacatcattttcccccctattcttcctgaccctcctttgagcaatagtgtcagtgggattagactcatgcattcacatactgaatgaatgaatcagtatgtgattcatgatatagaaaatttaaattccttatatatttcatatatcatatatatgatatatgtatctgtgcatataggggatattaaacacttctctgtatatatctgacatatattttgaaaaggaaacaccgtagggccaagttaactgcttcaattattacttagtgtaaatgcattcagtttgttctgtaatttcaaaatgatacatataaaaaagtagagtttgcatgtttaatacatctgaagctacagtttccaaattctgaacactttggtgacccccttgacacaatgaatatttggcagttaccgaacataacagggcacaaataatatagttaatgaaaacatccataattatttaaattaggctattttaagaaaagttttaatttgaacattaaacagcttaaaatcatttataataattgattatgtaacatgctggtcattaaaatgagattggtattctctttttttttttttttttttttttttttttccgaggtggagtcttgctccatcacccaggctggagtgcagtgctgcgatctcagctcactgcagcctccgcctcctgggttcaagggattctcctgcctcagactgccaagtagctaggattactggtgcccaccaccacacccggctaatttttgtatttttagtagagacagggtttcaccatgttgaccaggctggtctcaaactcctgacctcaagtgatccgtcagcctcagcatccgaaagtgctgggattacaggcgtgagccaccatgcctggccaagattggtattcttgacattaataattttggtaagcattaagaaggcaaaacatggaagcactcacaataatgtataggatccaagtaaaattctccttactgaaacatgaaactacaaagccatgtgcgcatacttttaatttttaagatttgtttgaaggaacttttgtgaatgacaagtagagaaagtgtggatagatagcatctctgtctttaaaattatttgatgaaataggtgataagaaacacaaaaattaataattcatgtgacctttattacaatacgtcttctggtattagcatagtaataagtattagtgatttacataattggagagataacacaaatacaaattatgcacacacacatacatacatacacgttcctgtgcttcactcaaaactgaacagatgttatttggacattgtactgtgtatgccattgtaactaaagtccaatttgttagagatagtattgttattttattatctttagtatcttcaatgagtccattatgaatagtagcattaactttgcttatgactagcttaaatagaactttggactccataaaaatacgaacaaagatttttaatggctttagaatacagaagtaatctggtaaaagtattcttgattttaatagaaaccaaacaatcaatgtgcccgttagattaacagtgaataatcagattgttccagctcttcactaatgaacaatgctgaaacaacattctctgtaggtctcctcagatagacatatgagaacacctagaagtggaattgttacctcattagagtattcacatttttaattttatcatatattgcaaattgcttttccaccagcagcaagaagtggcaggaatttattattttaatttgcatatccctggttgaacaagttttcaagtttgttggacagatttttccttctgtgagttgactcttcatatatttaccccaattttccgttggattgtttactttctcttaccgattaatatgagttgtctgtatattctagattctagtagagttctggattatatgcacctaatatataagtctacaattccttatccaaaatcttatcgttgacttttcaggagactagtgaaaatggctacttagtggaacatatggaaatcatgagttataagtgtataaaggctaagtgcaacagtctaaagacctggtatcacagatgaagactgacatattgagtaaaccaggaattggctttattacataatgtgtcctttttcttgatttcagaaacccatatatttgctgtttcctgtacatgtttaggaagagtattcagaagagagaatgcagatatattgttgctgtttttttttaaaaaaatacgagtttaattcaattacccatttgattgcttgagtttattagttatggtagcacttagaaagagttgttttagataatgactatgattttggtacagaacctaatagtaaaaacaaaacatctttaattttatttaaagtgcatgtcagtcatgaagtcagaattgaattgctcttttctttgcttttaatgaaaattagcctaatggctgttttatctttaaaaagcaacttctagtgtttaataataacagatttaagtaaatattctgttaagacttaaagaaccatgtccaattactatatggataataacttagagatgctctatattggtttaaaataatgcaaatatcactggccactattcagagatatgtcaaaatcacttttgtttaatatgtgcctttctagtccttagatctactgtattccctaatccttttggggtatataatccagagatattaggacccattcagccagaaactgaaacatgccatgatggttagaattcatcagaaccacactcaaatgaatgttaagagacatagcgtgataaaagtgcatctgaaagagtatatgaacagatgacattacatacaatgttgtatataagagaaaggaaggaaagacattcatatcatgtcatattaattcatgtacactgaaaatacagaccgtgaacagacattctttcatttgttccttcatgtattcaataatagaatgcttctctaccacagatgattccaggggaatttggcaattgctggagatatttgtggttgtcacacatgggggaggagaaagtgctactggcatcttgtgcatagtgaccaggcatgctgcaaaacaccctgcagtacacagggtagctcccgacaagaaataattatccagtcccaaatggcaatagggctgaagctgagaaaccctgattgaaactcacattacatcctaatcgaaactactttgttccgttctgagccgtaggattcatcaaataaaacctactttttattggtacaatatttaaatccagagaccctgtagcatagtaattatgtatgcaggatttgcctcagaaagactagggttcaaatctcagattcaccatatgttaggttgtgccctaggcaagtttctgacctttcgtgactctagttttttaatctgaaaaaatggtaatagtattgctgagaggctctgcaatggagattgagattaattaagatgatttatgttaagtgcatagcagagtgtttgcacttagtcagtttccaacaaatggtagcagtattacctttacatgtactaaatcatttcatcctgacctactatgaaaagcctgatcactttccatattttactgtttttaagataccattgattagagtatgcattgttattttatttttcaccaagaaaaatgtgctgccgttttagactatgacacgctatcatttataaaacgtgtcccaatttcagagcagctaacctgttgaaataaaatgtgagtcttataattgattattgtaaaacacaacagtaagtcttctttgattaggtgcaactgaacaatactatgaccacattcagtagcaaaggcacttagaaggatataggaatatagcttagcaggaaggtagcatcgggtatctctctttagtaggatgagtatgcgtagcaatctctgaagcacccagggagccatccaagagctattcactttgcagcacctgtccactctctcatgacatctcaggtgcacaggaaggaaacaaatcgagatgctgggtcaaccctggcctagaagccttatgcatcccagaggccaatgccttgtaacatagtttccaaggtcctcaaaaaggacatgcttagttacaagaattgttgtacttggggacgccccacaattatggttttccattaggtatttatagttcatatgtagaacacctaaccaaggtgtaatttaccagtccccatcatttttttttttaatctgaagcaatgttgcctgctcacacatttgacattccaactttatcagttttctagggagaagggagctagaaagttgatcaaagtacaaattctcatacagatggacaaagggtgtttttaaccctttactcacagtaatatctgttagtttcatttattttatatttaaagatactgaaacctgaaacttagagcagttaaatgacttgccccaactcatgggctaataagcctagaacccagatgttcttatttctagactgattatttccaacaacactgtaatatcctaaagcaagagtcagcaaactatggtccaagggccacatttagtcctccacctattttcagaaataaagagttattggaacacagccacatttatttgttcatgtattagacctgactactttcatgccacattggcagaatttgagtttggcccacaaagtctaaaatatttactatatggtgttttatagaaaatgtttgctaacctctgctctaaagtataattacaaattggccaggtgcagtggctcacacctgtaatcccagcactttgagaggccgaaatgggtggatcacttgaggccaggagttcgagacgagcctggccaacatggcaaaaccccgtctgtactaaaaacacaaaaattagccaggcttggtggtgcatgcctgtaatctcagctactctggaggctgaggcacaagaaccgcttgagctggggaggcagaggttgcagtgagccgagatcatgccactgcactccagcctgggcgacagagcgagactgtgtcaaaatagtaaataaataaacaaataaattctaattataaattgtttaactctttctatgagtctatataaggagtttatagaaaagcatttgtttctaatgtttgattattaaaaatacccctgtattttttattttattttaattgacaaataataagtacatatatttatgaggtacaatgtgatgttttgatatatgtttacattgtggaataattatgcatacttgaaggattttagagccacagagcctgaacctaaccgtttctctacatcagtgttggccaacttttttctttaaaaggccaaatagaaaaatttcagtcagtttttgaggcttcatgggccatttggtctctgttggaaatagtcaattcatgctaggattggaacctagataaccagactcaagagcccatactcttcaccagtaaggacttaggaaggcagcaagacctgggagtaccagtttaaatgaatgttcttctaagcagtgtcctgtgctgctattaaaccagaccagagctttggcccttagttaagaactgtatgtataaagttttccaaaataatggcttcaggttttcacaaagtccttccatccaaacaatgcagattgtacccccttaagaatctgttcttaactgccatctgttctctgcattcttaaagtctaatcttaatacagcagccagaatgatctgtttaaaaataagtcagatcacatcactcctctgctgaaaactctcctatgcttcctaatctcactcaggataacagccaagatccttccaaagatgcaggacctatcctcctccatccccaactctatgactatcattcctactactctccccttgctcactagattccactcaccctggtgtccttttttttttaattgaacatacacatacactcctgccccagggcctttgcacttgctgtctctgcacagattgttctttcctgagatagctacttgaatcgttccctcacttccttcagatctttatttaaataccacctactcagtgaggctttccctgcaggcactttctaaactctccacatgccacctccctttgccccatacctaagtctcttattcctatccagtgctttacattttgttctttagcacttttcactctccaaagcaccttaatttctcttttactacacattatcaccattagaatgtaagttttatgaggacacaaaaagtttgtctgttttattcgctgttacatatctagtacctcaaacaatgtttagcagacaataagtaatctgtcaatatttatggaatgactcaagtgattttttggaagagttttggtaatatttcatttgccaaaagaattctgccaaaaagactttgaaacccccactttaaggtggagagcttccatagaggcttctggatgttacttgatggtcacacctatgcccactctttcactggccttgaacatttcaagtatgcagcttagtagattatatcttcacagtttcacaacactttccagtttaaaaatcaatgctgcattatgctttgtatatttggacagattatttttgaaatccataaatctctaagttttttttttttaagtctccctttggtgagctgcccttgattagttcaaaatgggaagagagaacctgtcattctttgtcaatcaggttggcacgtacttgacagcatgcagttatagtgaaagagagctgtgttgcagtggtctagcaaacctaattgtagttaagtaaaagaacagtcacccaacatgagaggaaagacaaagaaactcaactgaacaatgttgtgtttttccatccatcagccttcatttgtcagagtctgactgacaatctggactgcagaaatcaggctctaacacaatattgattccatttcatattttgtttcttgctacactttttagcaaacagtttctgtatggaatgagagatagtgcagtcaatatatgcgaccagggcacatttatattaaaggcttactttggtttttttgtcccagaaatcacatattgtttgtttgttttactataatattgtaattgtcagctcttgctgcagtaacaaacaatgacaaaattccagtgacatataacaacaaacatttattactcactcatgtgtctgcagatcagctgcagctttactccacactatgaatcaagttaaggtcttttcattctagaatatggatctgctctaaatgtcttctcatcccaggaccctagcggaaagagcagcttttatatggcatattattctctcatgatggaagataagaacaaggggaaccagcaaatcttgaactgcctttaaagttccagctaagagctgccacacagtcccttctgtctgtccatggtctattggtcaaaggtacacagtcaagcccaaagtcaatgggaagggaagtatattcactgcagggcagccatattaagagaggaaatgaataataatgaactgacaaatcaaccatagtatccacaaatgtcttaggatttcattgattcccaaatgcattttttagtatttcaacacctctgaacttgagatatatcgtacaatagataatgtttacaaagtgtaggtttttttgttttttggctttcttagtttacataacaatagtggcccttatcatcaatgatagattagatagaaaaactgttaattgtggggttgacaaaatagccaaatggtagaaggcactccttataagtaagtaagttatgagtgggagctaagtgatgagaacacatggacacatacaggggaacaacacacaatggggcctatcagagggtggaggttgggcggagggagagaaccagaaaaaataactaatgggtactaggcttaatatctgggtgacaacataatctgtacaacaggccctcatgacacaagtttacctatgtaacaaacttgcacgtgtacttaaaataaaagttaaaaaaaattaagtgaatggacacttaatgtttacaaaaaagttgtcatttttatcttgaatttcttttttctgtagcaatatttatatctcattcagatcagcttatttgattagaaaaccaagcattaatagtagatcttatgtctatttattcacatattcatataccttcatttataaatatatattcatatatatttagaagatcaattggaaaacataagtgccattcccttatttaaaactcttgtagcttctccactacagttctgagggtggtatacaagatccttcttttctctggcttttgctttctatttctactccattacttcccattcccctacgtgatagctccgtacttcttctgcttcctgtctttgcatgttccatgttccctcttggaatacattctctctgccgtccatccccttataatgaggtgcatgagctgtttctgctcccagcctttctgtcctgaccttcttgtctatcaaacacaaaagtgatcagttcctgctctgtgctccattatacattgcactttactagttgttatacctgacctgctctaaatgtagtatatatttgtgtgtctgcactccccattcctaccccagtgaaacatagtaagcactgaataaatgtttgtcgaatgagcaaataaataaataaataaataaataaatgtttgaacatacatggaaaggttgtttatgtcctccttataatgtgctttgagatatatattcttaatatatatataatcatatattctaaggttattagtaggtaaaatgaaaatttaaagaaattgagtacaagaaaggaaaacaaggaagaattttttcctttttgtactatttctaagaacaccaaatttctagttaaacacacgcacacacaatcggcatgatgtagaattagaaatatgttgaataaatcaattattagaaaatgtaaatatatattaatttgcctctgacttgctacttttaccctcaagggttttttttttctacctcttttcatcactaatctttgcttcactgcttgtcagatcagcaactgcccattattagtaatgccatttaataagagataaataaaagtaaaggtgcttagagttactccatttcaaaaacctatcagggctggatttcagaagagaccatgaaattctcctactgttattgaaccattactccctattacctaattaatacaagttattttcttaaaattatacctgacattgtagtgaactatcaatactatgaagaaaatcaaactctcctcgtatcataaggatcttaacacctggtacacaatcttgcattggaggggacattaagaataaggcatggaggaaaaaaaaaccttaatggaaatgttctgttattagaaatgagactttttggtggaaatcccatgacgactttcttgtctgaatgttctttgaagttgaacactttctccttacacaagccggccactataattagctatgtttccattttagtggtggccttcttcaccttatctgaaatcatataaagatgtgaggccatttgcgagataaaaggtttgctcaaaccagttctctgacctggatatcagaggtttggcaatcataaacccactaagagaaaccctcagagctattacaaggctatgtaaaactttatttcattttttgtgagaagggacaggattttctctcatttatattctggaagaatattgtagaatgtatttgagttcaagaggaggagaaataattaacataatattaagaaacgtcaattttggaaagaaataataagcatatatgcacatgtgcgtgtatgcacacacacacacagtatacacaacagattcagaaagaaggaaatagagatttggtgacacatacttcctggatataatctcaactctgccatttgcaagccacatggtcttggataattgacctaatctctctcaattgcagcatctgtgaaattagataaaactttctttgtaggagtgtatgtgtgtatgaaaagcacagtgtttgacatataataaatgttttagcaactgtagcttgttaatattatcacagcagttaatatcactatagcagttagttgccattttcagcacagctaataattttagtagcattttctgatctttccatctcatgtggtttctttggagttgtttcttgctttgttttttagcttttctatgtcacattttatttgcatggagaaataacaaattttacaatttatttcacatattctttaatttttaggataattgtcagtttcttacagtttattttccttatactcactgaagaaaatatgtacgaaagaatattttcagtgaagttaattggatttactacagttgacccttcaagcaatagtatcttgcccttaataactgacctatctttgaactaataaattcaacctgcaaataaatgtagtgaggtaaattgtagaaatttatcttcaaaatggtctttctaaagtgatctatcaaaggtgcatttaattagaggtccagttctccaaaaatgtgccaaggaaaagtagccacaaagaatttagagctgaaatgaattctttcacccattgctctgtttctatagaactgagaataaatctcatatgggtacttaaaatctgtactatgtcattgaaggatgaaaagatgacaatagtgatgatagaaggacacggtaataggaaacatttcaatagagggaaatgatgtgagtatgcaatgttcattcaccagaggactaaatctagggctattttggtgacttgaacagggaatattctacttcctgcaagtgaaaaatatggacatttcatttggcatgccacctgctcttcagtccatcatgtagcaagcacccacttagtactttggagctctaagtaatacttggactactcaaatgccagccttgttgccatttctgtttattcgccaataacaattttattaattaaaatttgtatgtggatgtcttaaggaaattccttgtagttgtcaaagcagactcctgatcctatctatctgccagtgccttctgagtagtggtatctattcttcatgatttttggaactatttatgggtgattgaagaatatggagtggatagagaaggatgctagtcatttggctgcacacaagaaacacagatgaaatttttgactatttctgttcattttctaaaggtacagaattttcactggattgtacttgtaagcaattttaaaggaagaaatatccagccttttgaatttgttacagtgttgcaagacttttttaaaatgttaagaatttttatcatataggatgaattaatactctcataattttaggtttgtttcttccataattaataactatccttaaagattgtgtgtgtgtgtgtgtgtgtgtgtgtgtgtgtgtgtatttcttgattttccagagcaaacgttcccattcatttgttttactcaccttgttatagttgctcccattgtaagatatatctagtaagtttactgttgttacctaaatctgtttgctgaattttaaaaatgggaacatgtagtaaatttgggggaccacgagctagtatttacaaagtaaaccgagaacattggatataaaaccttatttcatttaacctccaatgaaggatatattcagtattattatttgtattatttcttgagcttccttgcttatctgtaatatgtaacatggtggcaccccttttcatataattctctcctcacttctattttgggtttttacatgttcttgtttcagtctcttctgctctttctatcttttcttggttcaactttcttctcttatcctgtggaggcgaatacctaattctggctctatcctcttcagtcactctacaagtatcactgggacaatattgtccaactactatttttacctccaaacctgtattcttagccttacccctaatctgcacactacgcttctttttgcaattactttctgtacatttgcatcagtgttaatcacaggcatcttgactcatgtctccaacctgaaaacattattccttccatatagggacaggctcctctgtcttccctgtacccctagacagtttctcccaagttataaaatcttggtgattctgaaaattttctttttccccatcaagtcctgccagtcctttatccacaacataggaataatacttcctgaacatccgtgctgctcctgtttgttcaataagtactcggacctctaaaggcatttcctatgtttcttccaccagccccttatccttaaaatcttgcctccaatctgccgctagagttatcatcttaaaagagtcaaatcagggttggtatccaagaaatattacaaagtactaagctcttggtatatacaatcaacttgagagaaagagagggacgggaggagagggagagagagagagagagagagagagagagagagagagagagagagagagactttattctgtcctctataacacctgaatgattctgtacatatttatgttaacagagcattgtactacttcaaatccttatacaagcaaaactcctcaccgccttttggcaatggaacttgcttttccctctgcctgaaatagtcttcagtatgttgacatgactcatttcttcacttcattccatttcctgaagagaggagcagtcttctgtgctcacattgcctaaaatagagcccactgtcactctctacttactctttttaatctttcttcatagcatacatatacatatatatacacacatatacatatatatacacacatatacatatatatatatatatgtatacacatatacaggcatacctctgagacactgaaggttcagttccagaccaccataataaagtgagtcacatgaactttttggtttcctggtacatatagaagtcaggtgtacactacactgtaatctattaagtatacaatagtgtatgcctaaaaactaatgtacatgccttaatttaaaaatatgttattgcagtgttcaagctgagagccaaatcaagaatgcaaactatttacaataaccacaaaaaataaaatatctaggaatacatctaaccaaagaagtgaaagatctctacagggctaactacaaaacactgctgaaagaaaccatagataacacaaacaaatggagaaacattccatgttaatggaaaggaagaatcaatatcattaaaatggacatactgcttaaagcaatctacagattcaatgctattcctatcaaactagcaatgtcatttttcacagaattataaaaaactatcctaaaattcatatgaatctaaaaaacagtctgaagagtaaaaacaatgctaagtgaaaagaataaagcatgatattaaccaacttcaaactatactataaggctacagttacccaaagagaatgggacttctacaaaaacagaaacttggaccagtagaacagaatagagaactcagaaataaagccgcatacctacagccatctgatctttaacaaagtaaacaaaaaaaaaaaaaatggggaaaggactccctactcaataaacggtgctgggatagctggctaaccgtatccagaggaatgaaactggactcctacctttcactatatacaaaaattaactcaagatggattaaagatttaaaaaaataaaatctcagccaggtgcggtggctcacgcctgtaatcccagcactttgggaggctgaagcaggtggatcacgaggtcaggagattgacaccatcctggccaacatggtgaaaccccgtctctactaaaaatacaaaaaaattagctgggcatgctggcgcatccctgtaatcccagctacttgggaggctgaggcaggagaaccgcttgagccagggagtcggaggttgcagtgagcccagattgcactgcgccactgcacttcagcctgacaacagagcgagactccgtccctaaataaatacaatacaatacaataaaatctcaaactagaagaatcgcagaagaaaacctaggaaatactattctggacatcagccttcagaaagaattcatgactaagtccttaaaagcaaatgtaacaaaaccaaaaattaacaagtgggatctaattaaactaaagagcttctacacagcaaaagaaactatcaacagagtaaacagacaacccacaagatgagagaaaatatacacaaactatccatcagacaaagatctaatatccataatctatagggaacttaacaagcaaaacgcagataaccccatgtaaaaagtgggcaaaagacatgaatatatagatacttctcaaaagaagacaaacgggtggctaacagatatgaaaaaatgctccacatcactcatcattagagaaatgcaaatcaaaaccacaatgagataccatctcacaccagtcagaatgcctattatcaaaaactcaaaacacaatagatgttggtgaggctgcagagaaaagggaacattatacgctgttggtgggagtgtacattagttcacccactgtggaaagcagtttggggatttctcaacttaaaatgcactgtcattcaacccagcaatcccattactgagtatatatccaaaagtaaataaatcattctaccaaaaagacacatgcacttgtatgttcactgcagcactattcacaatagaaaagccaaggaatcaacctagatgaccatcaatggtggactggatgaagaaaatgtggtacacatacaatatgaaatactacacaaccattaaaaagaatgaaattatgtcctttgtagcaacatgcatgcaactggaggccattatcgtaaatgaattagtaggaacagaaaaccaaataccactttgttctcacttataagtgggcctaaacattgggcactcatggacataaagatggcaacagtacatactggaaactagtaggggaagagataaggaaggggcaagagttgaaaaactaactattagatacggtgcgcactatctcagtgacaggatccatcatactccaaacctcagtatcacccaataaatatataaatgtaacaaacctgcacatgtaccccttaaatctaaaacaatagttgaaattatttaaaaaaatactttgttgctaaagcttgctagcagtcatctgagccttcaatgagtcttaatctttttgctgatggagggtcttgccttgacggagatagctgctgaccgatcagagtagtaactgttgaaaggttggagtgactatgccaatttcttagaataaaacaaccatgaggtttgctatgttggttgatttttttcacaaaagatttttatgtagtgtgtgatgttatttgataacattttacccacagtagatctttcaaaaatgaggtcaaggctctcataccctgctgctgctttaccaactaagtttacagaatattctaaaccctttgttgtcatttcaacattgtttacagcgtcttcaccaggagtagattctgtctcatgaaaacactttgttttgctcatctataagtagcaactcttcatccattgaagtttcattatgagatgacggccattcagttacaccttcaggctccactttattctagttctcttgcaattttctccacatccagtgacttcccctactaaagtcttggaccctcataggcattcatgagggttggaataaacttcttccaaacaccttgtaatgttgatatttacctctttctatgaatcacaaattttcttaatggcatctggaatggtgagtcctttccagaagattttcagtttacccagatccatcagaggaatcgctacctagggcagctatagccttacaaaatgtactttttaaagaataagacttgagagctgaaatgactcctttgtccaaggactgcagaatggatgttgtgttagcaggcataaaaacaaaatctcttggtacatcttcatcagacctcttggctgaccaggtgcattatcaacaagcagtaatatattgaaagagattttttcttctgtgcaataggtatggccagtgggcctaaaatattcagtaagtaaaccatgctgtaaagagatgtgctatcatccaggctttgttgttccctttatagagcataggcagagtctattagcataatcttaagggccctaggatttttggaatagtaaatgagcattgtcttcaattgaaagtcatcaattgcattagcccctcaaaagagagtcagcctgtcctttgaactttcgaagccaggcattgacttctctctagctatgaaagtcctagatggcatctttttccaatagaagactgcttcatctacactgaaaatctgttgtttagtgtagctaccttcatcatcttagatattagcttgatcttctggatagtttgctgcagcttctccatcagcacttgttgctccacctttcacttttatgttacggagagggcttcgtcctaaagcctcatgaacaaacctctgctggcttccaacttttcttctacaatttcctcacctctctcagcattcatacaactgaacagaattgggccttgctctggattaggctttggcttaggagaatgttgtggctgttttgatcttctgtccagaccactaagacattctccatattaacaataaggctgttctgctttgttatcatttgcatgttcactagactggcacttttaattttcttcaagaatttttcctttgcattcacaacttagctaacgggcacaagaggcctagcttccagcctctcttggctttcgacatgccttcctaaccaagcttaatcatttctagcttttgatttaaagtgagagacatgcaactcttgttttcccttgaacatttagaggccatagtacggttattaactggcataatttcaatattgttgtgtctcagaatagggaggcccaaggagaggaagagaggtagggggatgactggtcagtggagcgttcagaatacatacattaatggattaagtttgccatcctatatgggcactgtttgtggcaccctgaaactattaaaatagtaacatcaaagattactgattacccatcaccataacagttataaaaatattgaaaaagcttgaaatattgtgagaattatcaaattgtgacacagagacatgaagtaagcacatggtgttggaaatgttgctgatagacttgcttgatgcagggttgctacaaaccttcagtttgtaaaaaaaaaaaaaaaaaaaaagcagtatctgcagagccaataaggcaaaactcagtaaaatgaggtatacctgtacatatacatacatgtgtctatatatccactcacacatatgtgtatgtgtattatatgtgcatattatacatatatgttgatatgtgtatttatcatatctaatacacatatatgtatatacatgtatatcacacacatatattcatattgtaaattgaaaattttctagtgctgtatcccaatctctagcttataaatatattgaatagatgatgcagcaggtatcttttgaatacgcactccaattttagaaatataaatcttttttaaaggttggaataatataagtagtttggtgttcagtgcaaaaggttttaatgtataaatactatgaaaacaaaagttagatcaaatgtatcaaatacaaatgatctgtattgggggacagagggacacattaaatttaagggaatatgaggagaatattgacttcctatgctcgatgagtgaaaaagaaaagtgaagtgggagtgtttgaaaggaaagatgagcttttccatgctagtacatcacaggttttaatactcatagaagtttttagatttgtataggaaatatgatcctccagcctttccaagtttactcttctactggaattacaaatcaaaactaataaatgtttactatgcttcaagtgcaatagttataaagtacctgattagaggtcccacattcagatgttggttatataaaatattcatgctaaatcatataaatgctaaaacatttgtatttgtgatgttctcttggattgctagatggagattaaattatacaaattcagctaagaagaaaaatgtgggataaatggaattttagtttaaaggaagtcaatgaaaggattaattaagtataaaataatcccattttaatttgtcatagaaatgagttttctgagacattgttgtaatcaataacgtgaagatgtaaaattttgcaaaaaaaatcattacgggaaatccaaaagcagaagagtagactctgtatttaactctagcagattatttagaaagaaaatagtctatgccatgaacctttcgactgtctgcgtgaacaaatgtctctagtaatacacactcttaactcaattcccataggctcaaagttgcaacagtatttatttgcccgttcaacggttttttgtttagcacttactatgtgttaggcacttccagggatatgagtgaacaaggtagttatgggtcttactctcatagaggataattctttaggaatggtcaaaactatacatatacacataatgtgattaattgtgatgtgttttgaaggaggaagcaaaggagttggaacagtttaaataagactgtaggttggcagtgggaacaatggtctttgctatcatttttcaaaaattccaatgaatgggaatgacgactgttgcattaagttgcctgtctccctctgacccatagtgattctctattatcagagaggtagggcatgtttttcagcatatgtgataatatcaaacagattcagatggtgaaagtaaaatttcttaatgcttagaaataacataatttgatcaaatcatttggatatgttattaagttgttgtaagatatgaagacgtagctgttactactgccaatagtataaactttggattcagacctagctgtgtttgaatattaactctcccacatcccacgaggttgtgggcaagctattcacatcattgtcactaccgtcactactatcccacccacccttgcttcattttcttatctgtaaagtggcaatctgttggaatcagggttggggaaggcaaatagtagtcattatacgaatggtaactatgctatcatcaataatatagtctacagctatgatgaagctaatcagaaaacattgtctattaccagtaattagctatatcaataactatcacaagaaaagtcccagctgtcagtgaataaatagaaaatagtgctttgtcttagagaaacacatacaaaatgaatggtggtgacagtgctttaagttaacttgtcagtttatatgtgtaatgcatatataatttcaaatgtataatttagacattgtacatgtatatttggcctggtaatttatggtatacataaatgataaatgtataggttgaaaattcagttactttttttccttttcttaaatcatttttaccttgctgaagatatgctcttttctctacttccttagaataatatattttattttctcttaaagtattttgagaccatatcaccatttactacaccaaaatgtttttttgcaaatgcggtattcaagggtgaatttatagtggctggggacctatttggaattcagtaagtaaaactagattttccttattcctcatctgagatcagagctatttctacctctagcaaagacatacagtcattccgggtgctgcattttcagggaacaatgtgttttcttggcaaggggcagtaagaccatcaattaatagttcttcatgtaaagtagctaaactactgttataaaggaagtgaaatttgcatacataaccattaacacatgaggttagttatgtacaattttgaccaaagtgcctgtttgctgctggtatttattataataagaactggaaaaaaatagtctatctcaagagcatgtgctgagcacccgtaaattgcaagagactgtactgggcagtatgagattatagtaatttgggatttcctactaatgaactgagagggaacaggtacaaacacagtatacgaaggaaacagtggcacggagacacttaaacacagcagtgctgggaggctccggggtaggggagggaggaagagagatacgggttaatcaggagctgctctctggggaagattgcccaggccctgactgatgcctgacattgattaattgatactctatcctagtgtttaacaagtgttccatccaaaaagtcttctgtaatatttaacttcacttccttcagcttcaatttctgcacaattcttttgtcgtctcatcaagagagctagtcagcagacagtaacaaaatgcttatattcatatacctgaaggatttttttttgtcatgcttcagccttctccagactgaagaaaagcaaataataaacaaaattaatcgttcttcagaaggcctgtttgactcattaataaataataagctttgatactgtgctttaagtgtttaccctttggaaagaaaataattttgacagtgatgtagaaataattatttgatatttatttcaaaacaaaatttatatccaatactaaacacagaattttgtaaaacaataagtgtataaagtaaaatgaacattaggattattgagattattgtagctaaaactagtgtttattcatataaattatgttaataaattgtattgtcattattgcattttacttttttgaaaagtagttaatgcctgtgtttctatatgagtattatataattcaagaagatattggatgaattttttttaagtttaatgtgtttcacatctctgtttcttttctctgcaccaaaagctacatttttgtgcccttatgtaccaggcagaaattgatctgcaatacatgtggagtctccaagggtatatttaaatttagtaattttattgctaactgtgaagttaatctgcactatatgggttcttttccccaggaaactgaaatagcagttcaagctaaacaaccggatgtggaagagattttgtctaaagggcagcatttgtacaaggaaaaaccagccactcagccagtgaaggtaatgaagcaacctctagcaatatccattacctcataatgggttatgcttcccctgttgtacatttgccattgacgtggactatttataatcagtgaaataacttgtaaggaaatactggccatactgtaatagcagaggcaaagctgtctttttgatcagcatatcctatttatatattgtgatcttaaggctattaacgagtcattgctttaaaggactcatttctgtcctggtgtgctgccatcaatacaaaagtagtcccaccttcaaggtagattaaattctttggggctttattgctttgcttgccagccttgatgcttttcatattgtttggtttaattcaaatcaagctactgcatcatagtgtctgtctccaacagctgtaaagaatcacaatatggtccgtgacctttcttttctttgttgctctttcttataaaagagtaaaatcggcattgaggcttcagtattttattgggtcaagaatttttagtgaaatgtcatgtaattgcttatttctttggcaaaaagctggcctgggataaacctttctacttttttttcttctccatatccatgttgaagtctaggtcacatttattcacaggctattacataaggagggagatggaaagccaggtcagttttcaaaaaatagctaatcaatggcttccatttgcaaatgagagtccagtgctaaatatacgttagcagtaggttacctgattctctgtacctgaccagaattataatggctcccattatgatgaaggttcctgagatcctgtaatcatggctgtttattgatcagtcttggtttctcagttaatgttgcaggcttggatacaatgaacctcgtcctcatgtttaaaactgcttgaaaacagttcaggtcaataacctcattatacagaaccagtttgtccttgcaaacaacattaccatgacttagattctgtctctaaggtcgctgcttagtttcccttgcgcttggcccaagcttcatttctagaagattgtttgttttccttacagcttacaagagacttttccttaggtagagttgaagtttgcacctgagcttaatgtccaaacaccagacactgaaaatcacaggtttctctgtagatatcaacatacttttattcagaaatatattgcaaccactccaaaaatctagaaaagtagtttgtatccagttcaagcccagtataatcatttttcataagctaacaatgtgctcagtatttagttggaagagctaggcaaagtcctgaaagcagcaaatttcagagtttccgttgatgttctgaagaaagccagccctcagagcagttaatatggtgactttcattgtagcaagccatgcagtgcacaaatggacaattgcatacgtttctatctactctttgttgatcctcaaagactttatgccttatggtgtatgactatgaattaaggtttgtcactaattgttagagatcacaaaggtacatgtaatttggcttttacttttgtgcctttgtaaaagagagagagagagatcttaattaaaagccactgagaaaatttttgctttcattatgtataaaacaatccaaatgcttgatgctaacttatcgcacctccacccacacactcaactactgggccacttggagatcagaactgggatctgccatgcctgagcatatctgcttcctgctgatgcattagtgatgtaaaaggagaattacttttctgaaataaaaagaaagaaccaggagctgttgctttccttctctttcacaacccttaaaaccatttttgtagcagacagcactgtttttttccttcctttttttttttctccttccctgtttccctattttctctcaatttgacacattgggagaagctgaacttaagggaaaatttattcctgtcttcccatttctcccttggatttggagaaaaatcaacatatcaagttggctgggcatggtggctcatgcctataatcccagcactttgcgaggccgaggcaggcggatcacctgaggtcaggagttcgagacctgcctggccaacatggtgaaaccctgtctctactaaaaatatgaaaatgagccagctgtggtggcaggcgcctgtaatcccagctacttgggaggctgaggcaggagaatcacttgaacccgagaggcagaagttgcagtgagccgagatcgcgctgttgcactccagcctgggcgacacgagcgaaactccgtctcaaaatatatatatatcaagttgataggggcaaaaatgcaagaatgatttgagaattatggggtttaaaaaaatagttgactcacgcacaacttttgctgtggaccatgaccttggaaacatctgaagattagctggggtttgcggtagcctgaaacacctagaggctcaaaaaatgacctcacagttttgaacatgacacccagcaatacaaggcagaaagctgtgagggctgtttaaatctctgcatggatcaaaaatttatttttaaaggttagagatgatttttctgaaggacactccattgctctgatagaacgtgaacaaagcctttttaaactttgagtccatatatcaaaatttaaaatttgtcctatttataatgcctcttcttcactctgggtcttgttacctcttaatagaagaggaaatgagtctgagtagcctgcagcacattttcatgagagaattgtgtttctgtttttgttttttgggggaggtgcatttggaaactgtaataattatgaagaaaatgatattctttaaaaagaaaatgaaaatctctcacgatgtatatgcaagatctagtatttaaatgcataattagtgtgtccaccgcttacaaacattctaattaaagacacatcagggagcaattctgtttcttaggaaattgacttgtctattggcacctccgcattctgcatcagacagcctgtctgtccagctcctacgctcacctcccaagctgagttctgattggaagctgggttcatccctgctcagtttctttcctctttcttctttccttcacttcgtcaacttctttaagatttcttttattttcaaagatggtatatttctggtttcttttttaaaatctctgactaaccaacttctttattttctttgaggacttcctgtaaaaggtcaaatacatattatgaaatgataatactaatgacgtataggtagtactaatctctgctgcaaaataactggaaaaatcttaggatcgtatgatcaaatacctctccatctttgtttagcacttcaactctctttctctctctctgtctctctctctctctctctctctttccctccctccctctccactctctccctctctccctctctccctctctccctctctccctctctccctctctctctctctctctcccccttcctcccccatctacacacatacttttatttatttgtatgttatttcttcatcttaacttcagaaattactgaagactgactatatgagttatataaattgtttaaaattttgctaaagttatagttttggtataatatattacattaatgccatagatgaaatagtctttaatgtgttccatttttccacacagtaataactaggtcctcaatagcaccccatttagcagtttaaaagcagcaaaaacaactgctatcagtaacaacaatataaactacaaaagaagccatttgttatttgatttttattataaaattgtatttttaactgtcttgagcttaagcatttaggtgccattttcttgtattcatactcatttttaacttaagttggaaaactacactttcagttaacttttaaaaatatgtttatgtactttcaatgcttacatcacctgccatgtattagaactgagagcattaatggaattttaaatgtcttggttactttctaaagtgataaaatgaagccagctggtttgctttgctaactttttatattatcaaaaaatgttacttacacaaacctagtaatatgttttacttactgctcttgaattatttttcaatgtaacagaaaaaggtgtgaggaactttctgtatttggccaaagcgttccatcccaacctttaacacaaaataattgctgtagacaaatggtcaagagggcaattataatcttccaggcatcatttcctcagatatgaactgcaaaatgacagcatcattagtcattttcaattacagtcagtcacaaccagggatgattcattttcccagctgttttgttgttaattaactagatgaagctgtttttttttctcccaatgagtttgttctactgccaacatcaacatcttaacatttttaaaaacttccttagggtttattttttgcctaacaatctttaatatattactcacaaaagatgtgcatctcaagatttatccacggtatagcaggtcaaatggtatttcattggtcgaaatgttgccgaaataaatataattacacttaaaacaatacttggatttcataaatcatctgccatgcgtacaatctcatttacctggtgtaacttcacttgtagcaacagaaatcaatagagagataacagacaaaaattgtcccctgaaatgaacaagtctattttgactgactcatttattgagcacaatttccatgccaataacaccagaataagttgggagaggacttctagaaagaagataacaatattagaggcatttaataatttataagtaaatgcatagcaacattttatttttttaaattacaagtttgcgactgggcgcggtggctcgcgcctgtaataccagcactttgggaggccaaggtgggcggatcacaaagtcaggagatcgagaccatcctggctaacatggtgaaaccccatctctactaaaaatacaaaaacaaaattagccgggcttggtggcaggcatctgtagtcccagctactcgggaggctgaggcaggagaatggcatgaacccgggaggcagagcttgcagtgagctgagatcacgccactgcactccagcctgggtgacagagtgagactccatctcataaataaataaataaatacaagtttgctttacaactgaaaaaaaagtcttggagtataagaggttgaataaatgctaatcccaatgcataaacttgaggagagcttcactttcccaatgagaagagaaaaaatttataatagatttttgggcaacttgtaaacataaacatttagaaatatggatgagattgtcaaatgtctaattatattcaatttcttaattgagtagcatttccatatttgcagtcttacattttataaaataacacactcatttagaaatacctggcacatttatattttatgaaacaatttcattcaaacccttcgtatgtatattctagaattgtagagctcatcaccttgctaagttatttgtaatatggcattgtttgaatccctacataatactctgaaagccctctggccaagattacaagcaacatatctgtaatcaaaaaattaagaatatttaccttattgcagcaagagcgtaaaacacttcagagtgtgggcatctcagtaagagggcattggaaaaagcttcttacagagttcagctggctgcatgattctaaggaggaattcagaaagtagaagccatttctggattagatgctttcaagaaacagagtcaatgtagtgattaggtatcttagtgtttatctagaagatgagattaaagtagggctagacacgtcgttggtaaaggagcagcaatgcctcatattagtcatttctgtgatagcagaaaggccttgtctctgtcttgtttcaaacacggccatggggtggccttgtgtctgcctagtttatttctatgagtgttttttaacatccagctgggaccatcatggcctagctagctgccagctgccagctatcagcagagctatttttcacgttctcaatgctgtcgctgaaatttttatcccaaacttcaatacccattcacaaaatattaggaaaactgtttttttcatttttcttagatatgattttggttgtttgtttgtttttgagacggagtttcgctcttgttgcccaggctggagtgcggtggcgcgatctcggctcaccgcaacctacacctcccaggttcaagcgattctcctgcctcagccttccaagtagctgggattacaggcgcccaccaccatgcccagctaattttgtatttttagtagagatggggtttctccacgttggtcaagctggtctcgaactcccgacctcaggtgatcaggctgcctcggcctcccaaagtcctgggattacaggcgtgagccactgcacccagccagatgtgatcttttaaaaattcccaatagactaacatattctttctgctttttaagttgtttggctttttaacaaattctttgaaagactcgtttacaatgatctctgccacgagtgattgtgaagctatacattaggaatgattgctaaagatttatcaactttctttgcctccctttttaattaagcaaattctgtcagaatacttatgtaagcatcacatctcttgaggttatttcaggctaatatacaacattgtggttccgaataaaataattgagacataagagatagtataaagtcttgaatatgagccaactttcttttctgagagaatatttgagtgaaaagtctcatgtactcagtagctcatgctgaaattagggaagcattttagagatttgaatttcacctcttgtcctcagttgtattagttacacttaaagagagagacaaagagacatagatgtttcagttacaatattcgaatgtatgcctgtatatatacagccgtaggtagagtcctttatttattcagtagatattaattgcatgccaaccattgacacaagatatatttttaaattttgaaaatctcaaactcaaatagagtttaaaactatattctagtttacttttttaaacaaatgattttttatgattgtattaaacaaatacattatttttccttacttattctacatcaaataatatctatttctagaaggcttttttccttgtcttaatgatagaaaacataaaaatcatttaatattttttaaatatccaaaaaatatgaggcaagaaagcagccacaattgtagctaccttaggaaacttaattaaaaaatttttttttatttttaattttatatgtgtataattgtacatatttatttgtgcggtacaagttatattttgcttattttttataatttcagtagttttgggggtataggtggtttttggttacatggatgagttctatagtggcgaattctgaaattttttatgtatccatttcctgagtactatatactgtacccaataaatagtcttttatcccttacctcactcccaagctccccacttagagtccccaaagtccattgtatcactccgtatgtctttgtatcctcatagcttagctcccacttacgagtgagaacatatggtatttagttttccgttcctgagttactttacttggaatagtggctgccagctccattcaagttgctgcaaaagagattcttttttatggctgagtaatattccatggtatatagataccacattttctttatccattcattggtcgatggacacttgggttggttccatatcttgcaattgcaaattgtgctgctatttttgtgctgctgctttcttttttgttatttccttttctggttttggtattagggtgatactgacttcatagaatgatttagggaggattccctctttatcttttgaaatagtttcattataattggtaccaattcttctttgaatgtctggtagaattcagctgtgaatccatctggtcctggacttttttttggcaatttttaaattactgatattcaaccttgctgctcgttactggtatgttcagggtttctttcttttttttttttttttttgagatggagttttgctctttcacctaggctttagtgctgtggcatgatcttggctcactgcaacctccaccttccagtttcaagtaattctcctgcctcagcctcccaagtagctgagattacaggtgcccaccaccacgcccagctaatttttgtatttttagtagagtcggagtttcactgtgttggccaggcaggtctcgaactcctgacctagtgatccacctgcctcagcctcccaaagtgctaaaatcacagacgtgagccaccgcgcccagccaaagcgttcagggtttctatttcttcttgatttaaactaggagggttgtgtgtttccaggaatgtatccatttcctctagattttctagtttgtgtgcataaaggtgttcatagtagtagtgaatgatcttttgtatttttgtgatgtaggttgtagtgtttccagtttcatttctacttgagcttatttgaatcttctctcttctttccttggttaatcttgctaatggtctatcaattttgtttatcttttcaaagaactatttgtttcatttatattttgtatttttttgtttcaacttcatttagttctgctttgatctttgttatttcttttcttctgctggatttgagtttagtttgttcttgtttctctagttccttgaaatgtgacattaggttgtcaatttgtgctctttcagaatttttgatgtagtatttaacactatgaactttcctcttagcactgtttttgctgtatctcagaggttttgataaattgtgtcactattaatcatttcaaaaaatattttaatttccatctcaatttcattgttaaccccaaaatcattcaagagcagatttcttaatttccatgtgtttgtatagttttgagggttccttttggagttgatttttagttttattccactgtggtctgagaagatacttgatatgattttgattttcctaaatttattaagactttgtggtctcttgtatgacctgtcttggagaatggtccatctgctgataagaatgtatattctataattgttaggaagaatgttctgtaaatatctgttaagtccatttgttctagggtgtaatttaagtccattgtttctttgttaagtttttgtttcagtgacctgtctagtgctgtaaatggagtattgaagtcccccactattattgcattgctgtctatctcatttcttaggtctagtactattgttttataaagctaggagcaccagtgttaggtgcatataaattgagtactgtagtaaatatcttcttgttggactaatccttttatcattatacaatgtctttctttatcttttatttacggttattgctttaaagcccattttgtctgatataagaatagctactcctgcttgcttttggttcccatttgcatggagtatctttttccgtccttttaccacaagtgatattttgatacaagcatataatatataatgatcaaatcagagtgattgcagtatctatcaccttaaatatttatccattttaaattttaaaaggaaagctatattcagaaatcactttttcttgtaactaattcctgttcttcataaagcagaaatttcatagtttgatatagttgtcttaacatttaatgaatattttcaagcaaagtatatacaatggagaataatgctcagctgcaaaagtcacctataataaatctgatttttccatttacaaacaaaagaattcccaaagtttatccattttggtagaacacgaattcactctgttgagtttggagctcttgtgcggaaaaccttggacctgcaatttagttagcatattcaaagttttaaaattatggagatgtagtcaagaataggacttgataactattatcccactgatacgctatttaaataagttgggatttaagtacttatttgatttccttaaatttgcttatagatgattaacatgtattgcaaattgttaccttttacagatttctattgagcactgcttaaattttattatatgatgaacacctgactagttgctacagccaaacattttttgttatgcaaatgaattttacagcttaattggaatgatgagagaattgaaaatatgggcaaatgccagagaagtgaaaagcaaaatgaagcaaaacaaaaaagaacttgtataatatataaataatccatttcaactctacagtacaccaaactcttgaaaaagtagcaagattgtttttgtgaacagccaaatcaaaaactgtagtcatttcataagtatttgctaataattataaaagattggaaattatacagttctgagcttattgaacctttgacccattgcagtgtcctcagacatttgtgatacattggtagtgccatttaattttaaaaatccacctctacattagagattatagtaacccctcatttacctatctggaaataagagtgggaaagataatattagagtaaatggacagactatttagagtttatgtattaataaaagagaaattgcatgtacaaacatgttattttctaggtaactaaaacctagtcctttaataaagcactgaaaaaaattttatcgtaactattttaatgagaacttttcttgaatatcttctgttttgcttcattgagcagcgcataatatctaaccaacaaatttatagtgctttgtagttcacagcatttttaccatataaaatatctcgtttagtttctccaacaaagctatgagttaggtggtattattatatccatgtttcaaggatgataaatcttagtgacccatctcattttccaaggatcacacaaccagtagtagtgaattaggaacgaaacctaagacttctgattctaaatcacaatgtaaattaacttttcttaattttcaggggtgtcgttatcacatcaatttttgctctgtttagtgatacagtgttatatgaggaacatgaaattcaaagcaccctttcttcagttgagacccagttgaagtggttaatttgcttttagaagctagactgtaagataaatacatacctttaagtattaaagctaactcaaatcactgagatacttacaccatgagaagagagtggaacctaagtcaactggtagaaacatagaaacagcaaactttgatctctctttatcctcattctgaggggcaatatgcttactgagtggaaagatgggcatacccccagcagtatttaaatcaatccctaatctatcactatctctccttttctctctatctcagcacatataggtgatttcctataaattaaatggtgtaggatgagatttcatcccatgttgaaaggtcatttcattgataaatgactaagattaccacatttctcagttttaagtttttcatgttcattgtctcctattgctactttctgttatcagaatgattacttctcattgcttttagtattctgtctttgtagggttacagaaacttcacagggaaaccagaagatcaaatatattactcactagtctcttagaatatttaatttttagtgtttaggttctgatgtcaggacaggaaaatatcttccgtgagtgatgacttccaagggtggttttcctgactaatcagaggcattattttttgtttgcttttgggttcaagactgatttttaataaataaaaaagttacatttattgatatgctagtaaatatttacatcatgcattctggataaaaacattgaaagccttgatttgacttgatgtcagacacaatagacatagtctcaagagcactgatgatagttaaattaggaagtgatgaattcttactatatattatcttttgttcttagcacagtttattttatatttataaaatttaatttatattaatggttatgtttaataaccgattagcaaaattactgaaatgtgacaataatatctctattcctgtttctttcctgctttatccttttaaaatatattatttataagtatattttaaatttataaaagctacattgtgctataaatcttgtttcttagcttttctaacattcataattgtgttttaaagatccacccatggccgggcgcagtggctcatgcctgcaatcccagcacattgggaggccaagatgggcagatcatctgaggtcaggagttcaaggcagcctggccaacatggtgaaatacaaaatacaaaaattacccgggtgtggtggtgcgagcctgtaatcccagctaccgggaggctgaggcaggagaatcacttgaacccaggaggcaaaggttgcagtgagccaagatctcaccactgcattccagccagggcaacaacagtgaaactccatctaaaaaaaaaaaagaaaaaaatccatccacattgctctacatatacccttatccatttctttcacatacatacccatgttggcctcaattccccacaatgcagcaacaaactttcttgtacttccttatgaccttaagaatgtgagagaaacttctccggtatacactggtgagggaatatgatcagcagggttttttgtttgtttttctgtgttttgctttttaacttatgcccacctttctgttggcagtcagcagccacatctgaagttatagctctctgatttagacaaggcttattcttccctttgttacaacctagtccctatagggacctgaatttgtgaccctagtctatgagattactttttaaatacagtttggttcaggatttataaaagcctaataaggctgggtgtggtggctcacacctgtaattccagcgctttgggaggctgggatgggcagatcactggagtccaggagtttgagaccagcctgggcaacatggcaaaaccccgtctctacataaaaatgtatgtactcagtagtactactcagtagtagtactgagtagctactcaggaggctgaggtgggaggattgcctaggaagtcgaggctgcagtgagccgagatcttgccactgctctcccgcctgggtgacagagtgagaccctgtctcaaaagaaaaaataagcctaataaaatgattgcacgcctggaaaacctacataggctccttcaagtcccatatatatataaagtcatccatggtatgtagttcacattgaagtcaagttgggggaaaagaaacttatttatctctttctcttttcctttattcaagtagcaattttcatttaattttattcaattcagaaatatttactgaactcctcttattaggaagcactagactggatataaagaaaacatcgtacaaggcatagaggactcagtcctgccttgcgaagggcacatagtctgactggaaagacacatgctgacagggtagactgtgttaggaataatgctcaaaatcctgaggacattgaacactcgaacaaaggattcttagcaaagcaattttacttctgcacagaggggtgcctccttggccagttgccatgagagcacacctgaacaaaggggcatgagagcctttattcctgacgcaagtcctgcccctgtaccctttccccccattggctggggttgggtcgtacaatctaaactaatcccagttggctaaacatttgatttttttagatagggtgggcacgtaaaatcaagtggagaggaaggggaaggggcgtctgtaatgagctagaaagttagtcctctttccaaataaggaaatgaatgtgagctggtactgaggtgtgcctgggcatctaacaaaggtaaaaaggaaaaaggagaaaaatcagggggtactatgaattaaagaataaaagattgatcagattatttgaagagaaacctcatcatatcccacaactggaagaaacaatttgatggcaagtttctcttcgtcgtttaccagctcaaaatctcaactatcaaaggcaagaaaaatacacacacacacacacacacacacacacacacacacacacacacacacccctctgcctttttctgtatggccaaagccttcagtccagctgaccacttcccactccagttaccatgttagcctcccaacttgtatctctgcacccttctgataaagcctccacaatgcaaaacacgaatcgtatcatatggctcttcttctctaaacacttccatctactctgtggttttagaagagaatgtaatagtcccacattacaaggtcttaataaattgcattcttgcagctctgtatcattacttgtaaacactgtagtctagatagccaggacacactgcatttcttttttaaggctcgatacctcttgccattttgcacgtagttttccttctgtctgaaatgccctttttccacctggcgcttgaatggccccttctgaaaacttcctagtcgtctttcaaaataaattcaaatgttagcttttgtgggtaacctattgacctctccaggctgagttaagctgttcccccgaggtgtcttgttgaaatcattattttttcctaaaatctctgttctaatttacttacatgtctgtgaatgcttagaggttacgaacttcagttttgtaagcttagtaactggcacaaagtctggcacagagtagcacctgaacaattatttttctggaataaataaagtaatggtttcattgaaatgattcgcattaaattaatgattagcattaaactacaacgtgtatatgaaacattccagttaggttgggttcattccattcctatttaaagagtttgtagtttctggctcttttccaactctgattcttcagactagaaatgcaatttctgctaatgtatttattttaaccaaacccgacatcaatcaagttatttgtattcctcataaggtaagcataggaatttacagtgatacaaaaacgcagctattatctcttataggcactggtaaagcttttgtgactagtgctactatactggtaaggtattgctgcttgtaatgaactaaatatttcagtggcttaacacaataggagttcttttcttgctcacatgacaacccagcgtatgttttcctagtcaagcagctttcttacatatgttattgcagaaacctaggtcctgttcatcttcttcctctgcctgccattcccttggtagcttttctctgctcgggtttcgcaagaggatgaaatcctattgaaaatgatctgagggtctattatgttctcaagaatggtacatatctagtctatgataaatgctcaggtaactgattaggtgtaatagatatcttaggattttgtcatgaacaatcagcatcaacaccacctggaaaattgttaaaaatgcaaattattgggctccacccagtatctactaaatccagaactccggggctaccatgcagcaattagcaaggtctccaggtgattctgttgatcctaaagtatgagaacaactgccctagggcgttaggacttaattctctcctcagtaagttgtaaagatttgccgtaggacctaagagtcttctgcttccagcaatagaaaggaaaaaaaatgtggaaacctcactaaatttttcaaagcctcagccccaaactgacaaacaacacttctgctcacattctgctggctataaattatcgtatagctagctgcccagtgaagtggaaccagctcaggacggcctactgttatattgccaggcattttttgagccacttgatgttatcttcttggtaatttaaatttaaccgtggtaggaatatttacaccacagaaattggcaaacactaaaaacaaggtgtttttaaacaccctgagatcagagatccagttgatatacatctaccagcacaccactggccatatacaggcttgccttatgccacggggagctctgcagctgaagtagcccttcaaacttgtcctgctttgagccaaattaggcctctatactttcaccttcatcagtcactgaatgagggctgcctggggaaaggcatgaacttggacaaggcagctctctgcagctcaggcagtccctgaagggactgacagttgaagaatgtctactgacatcatttccatcatctagaacaagagtctttctttgaagggggctctgagtagcatattcccgtgtccactgcagcccctccctttaagagactctgatataattgactgggggtgagccagtacattaggattttcctaaagttatctggataattttagtatgcaaccacaatagatactcttcaagaattaagctagttgctgagagggaactgttttttgttggtttgttttcactaatgtttgcactctacttcctttaaataaaattatgcctggagaaagggtttttgtatggagcaattgataaatatttgtagggtggttggctaaaataattataattcctttaaaagaaattctacccactaaagttaatttagaagtaaaatataatagaaatccaataatatattcaccaaatggattaagatgttcatgaattatcttcaaagtgttaatcgaataagtaatgtgtatgcttttctgttaaagaggaagttagaagatctgagctctgagtggaaggcggtaaaccgtttacttcaagagctgagggcaaagcagcctgacctagctcctggactgaccactattggagcctgtaagtatactggatcccattctctttggctctagctatttgttcaaaagtgcaactatgaagtgatgactgggtgagagagaaaatttgtttcaattctaaagatagagataaacctttgtgttattgactgtgcaaaaagtcttagagtacattccttggaaattgactctgattcaaagtgttgcatgacaacgggatatggggagtgttctctggagatacacccacaaggaagagaagagcacaagggagattgtgggagagtctgaaatgtgatttgtctgcagcagaggcctaagccagtctcgcaggagccctacatctgggctggctgtgcagagctgtcctgaattgcaggcagtgggcctggcccttgtattcctgatccagccagccattggccaggggctggctgctgcctgagagtggaaggacaacttggacaagttttctgaggccgaaggcaattcttagtaaggaacaccattaacaaccaatattcctagcatccagggatgtgtgcattgttcctgaagagggacaagtatgtctacaaaaatcacagaaaccacagaaacacacacagtcctactagcacctctccctgtcccatttgcaaacaatttaagagctctcccatttttagttcaagaaaaagaaaaatggattgggaggaccacaagctgacttgggggaggaatatttcctcatttagctgtagttttaacttttgttttcactgcatattttcagtctattttattttctttcctcttcagttgttgatagaaggtattcataaattctcatggcaatgttaatgctggctttgactctcaggggaaagaggccagaaaacttctttgctgtaccattccataattaggcagaactaaaaacatctttgggtgttgttttttgtttttgtttttttttttgccttgtctgcttttcaaagatcaaatgattgaagcattaaagcatggtgactggttcttcaggtaaagttgatttttattttatgtcaagtagaaaaatactgaactggaagaatcacagctggggtagcacaatcataattcattagaaggcataaatagtgcttggattaaaagaagccctacaatctggggacagtgcatctcatgtgccctctgggattactcggcagtcatcagagttagatttaacgactttggagacttaagcattatggttttttttttttgtcaatctgggacactgaaattgctgtatcagggttatactcaactgtgtcaggtttatttgtttttatgagctgtaatttttggttccctcagcgcatatgcatagtttgttcctatgttatcatttattggtgtctgttttctggctgtctctggtaggttcagcctcagactctgtaactccatgaagagattatgttccaatgatgttttataagtttgttaaactctgaactcatgagtttatgtcccatataagccacgttacacatggtaggaaggctccaaaaccagggcgccgaaatccatttaacgtgtaacttacctaaatgtaacaatgtttataagaaaaatacattggaagttccagttttgacttccagcaacatatataattcatccactttatttattaacttccatgtgttgagcatcatactggtgctgcgagtacagcatagaataaaagtctctcctttcataaaacatatattgtaattgaaagagaaagacaataaactaatgaagaaaatatatactgtctcaataattataagtgctgtagagtgtagtctacagattgatgtcaatgggtatttgttagacacacagaatctgaggcccctatcctagacccactgaatcacaatctgcattttaatagaatccccaggtgaatcctgtgcacactgacatttgagaaacaccattacagagaacaactaagcagggagatgggatgagggtattattgtctatagtgtggtcagggaagcttgtctgttaagagaacatcagaaaactgatgtaagtgaggaagtgagcctggtgtatttctgggaaaattattccaggcagggagagaaaagactgagcaacgatactgaagtaggaacaagatgacggaatattaaggagatcagtgagactagaggagtgggtcaggggaagtgtgatggaagccatgagagatactcatctttcatagcactgccctacttccttctccccaacatgagggtctcatcaccccccaccactcttgtcttctcctatgtcctccacattgctgccagtatggagagtctgggaatgccctcagctcaaagctgtttggtgatagctggcagagttgtggtagtagctaaaaaagaattaagggaaagaggaattttctcaaaagcaggtgcttttcatcctctttagcaaaccgaaacagatctgagcattaagtcaagatgttaaatacacaaatgttgaatgaaaaaaaaaacaaaaggtagtcatttaaattcagagctgcttttattaaaataagattttcttttttctttactgtggtagttcaaatatcagaataaagaattgtttctattcccgacttcctgacttgcaggaagttaatcagaaataaatgcaatataaaaaaagaaaatctaatttgtattatgcttcttgtatatgtttattatttcatgtactgtattacaatgtaatagaatttataattcattatagcagattgtttccattgcattcctactattaaatatgtagaagctacacatatacttgtagctttaacatatatgtctttatcctcaaaataactgcaaagaacatatagataatttttaaagattaaggagcctgaggtttagaggggagatagctagattaaggccacacagctagaaagcaagcaagcaagggtttcagtccacatgtcaagctccacagcctgtgttttgttttgtggctgtgctttacactatctctctgtccaagaacctaatggaaaattacagatacagatgcagctggccagcagttaatataatttaactcaatcttaaatttatctggagtaaaagtgatacaagtttccgtgttttttcttttctttctttcttttttctttgtgtgtgtgtgtgtgtgtgtgtgtgtgacagaatcttgctctgttgcccaggctggagtgcagtggtgcgatctcggtttactacaacctctgcctttcaggttcaagcgattctcctgcctcagcctcccaagtagctgggatacaggtgcgcaccaccatgcccagctaatttttgtagttttagtaaagacggggttgctccatgttgatcaggctggtcttaaactcctgacctcaagtgatccgcctgcctcagcctctcaaagtgctgggattacaggcatgagccaccttgactggcctgtttctgtgttttttctacttaagaagtagaaaaaattggttcactctatttgaatttcttagaaccatagaaatccaaacttggaataattattgcaattattatctagttgagtattcttcttttatagatgtagaagctgaggcctaaagttgcttgttttgttttatgaacactaaaccaaactaccttgtggctgcttacttaaattataaattataatggggtggccttgcctgagctgtataaattgttttaattatcaggacaaatcaacatactggaaaaaaaaagcaaaacttgcaattgttgttgcttagacacctgtccatatcagtttctattgttgcatagaagcaccccaaaacttaacagttcaaaacgagtgatttattgctcataattctgtgtgtctgaagtttgctctgtgattagctggatagttattctgatggtcttgcttggtgttacttatgtggatgcagttatctagcaagtgaacaggagctagatggtctaaaatgcactctctcagatatctgacagctggctgttggttgcagaaccttgattcttcataaggccactcatcatcctgtaggctagattaggcttcattacatggtattctcagggcagttttccaagagagggcgggtggaagctacaagaccttctgatgcctaggctttgaaacgtgtaggttacttctgctaagttatattggtcaaagcacctcaaaagatcagcccagattcaagagatgaggaaattacttcatctcgtgaaaggaggagatgccacatcgcatatcaaaggggtatgcatattggggatagaaggttttattgtcaccgtatttatacacaaatcactacattggggaaaaggagggaaactggagatcaaaagtgttggtcttaatccaacttaattctcaaaaattaccatgcgttagaaccacccagttcttcgcaaagtatagattactgggcttcaaccccagagtttctgatttactagctctggggtgagacctgcatctctctctctctctttttttttgagactgagtcttgctctgtcacccaggctggagtgcagtggtgcaatctcggctcacagcaacctctgcctcctgggttgaagcggttctcctgcctcagcctcctgagtagctaggattataggcacccgccaccacgcctggctaatttttgtatttttagtagagacagggtttcaccatgttggtcaggctggtctcgaactcctgacctcaggtgatccacctgcctcagcctcccatagtgctgggattacaggcgtgagccactgtgcccagccaagacttgcatctctgaaaagttcctaggttatgctgatgctggcctatgctttgagaactactaccacagacatacagtgagtggggaagaataaattcatcccttctgctgtgtgcagcaaggagtgggattccaatgagatccagtgctgtgaatgctaaagggaaatccatcttattttagcacctctactccccatctccccaccccgaggatgttatagcttagaagttcaaggagatggacaacacactaaaccaggcagtatttgccctgcagagctgttcagtgttcctggatgagacctctgagaagaaaagccataagttcctctagagactttcacaatcatttaggtagacaggactttgcatgggtctgaaggcttgcatggcagatggaggcaaagagccagcaaatctggttgtaaatgtcaatgtgaatcctttcttatccacaagctgctgggcctgagaacattaatgttctacaatacccgatttagcatttttgaaagaaattgcatatagacatgcttaatgtgaagactccaaatcaggatatttgattcaaatgtctcttggtaataactatggaatgaataacccattgtatatggacatatagaagagccagttaacagagttttctttttttttttttttttttttttttttttttttgagacggagtctcactctgtcgcccaggctggagtgcagtggcgcgatctcggctcactgcaagctccgcctcccgggttcacgccattctcctgcctcagcctcccccgtagctgggactacaggcgcccgccaccacgcccggctaatttttttgtgttttttagtagagacggggtttcactgtgttagccaggatggtctcgatctcctgacctcgtgatccgcccgcctcggccttccaaagtgctgggattacaggcgtgagccaccgcgcccggcccagagttttctagttgattaaacactggtaaaatcatctcttcctgtaattaagtttggagagagcaagtctcaagtgtaattaggaaagcacagtattggaggtcaagaagcctaaattctgatatctcagttgtgctaccaactatataagggatcaacagactgtttctgcaaaggaccgatactagatattttctgctttatgggtcatgtggtcaactctgtcattgtatactaaaagccacagacaatacctaaataaagggacatggctgtgctccagtgacactttatttacagaaacgaggcaggtaagatagatttgacccttagtgggctacccatttccccttagcactcagccttcctataaaccatgaagcgtctaactacaagtacctgtgagtcttcctgagtcctttctctgcctgtaggagtagctctcccacttgcagagcaggctggaagctggggaggagattatctctggaatagcacttaaccaatggacaaaagctgggggataaaggtgttggtcttcatagttttcatactgctatgaagaaatacccgagactggataatttatacaggaaaaagaagtttaatggactcacagttccacatggctggagaggcctcacaatcatggcagaaggcgaaggaagagcagaggcacttcttacatgacagcaggcaagagagcatgtgcagggaaactgctctttataaaaccatcagatctcatgagacttattcactatcaggagaacagcacaggaaaaccccacccccatgattcagttacctcccacatggtccctcccacaacacgtggggattattggagttacaattcaagatgagatttgggtgagaacacagccaaaccatatcaataaatatcccaccttcttctccccttgggtaggacacctccaatgcatgttccacactaaaaatctccagtgaattgggcagttgaccacaatgataagcatacttattagcatgcctcgtataggcttccttccgatgtgtaggctttcttcccattttggcagaatctggacccaaccccacatctcctgagtttgatttcagtcctcttcagtattctcatatatctcaactttgttccctgctgagatacaactgacagatatatatgtatcttcagctctgcagctctatcttctcttctaccatggctttctgggatcagctcccaattgaattatttgtatttaaatccttgtctcagggtctacttctgagcaaacctaaattaatacaagtcttagaattagtgccacagttataccttttgagtaagttatgttgcaattcccattttatagatgagataaccaagggtcagaaaggttaaataatttgtccaaggttacagagctagtcagtgacagagtgggtattcaaaaataagtctctatgattccagagcttatgctattaatcagtgcaccatgtatcaagcagtgatttagttatcttcatttgaattttttgaagtctctatttaaattgaatatcaaatcctcacatataaggttatttatacctttttatttgttttatttatttatttatttttgcttaacttttttttattatactttaagttttagggtacatgtgcacaatgtgcaggtctgttacatatatatacatgtgccatgttggtgtgctgcacccattaactcgtcattgaacattaggtatatctcctaatgctatccctcccccctccccccaccccacagcaggccccagtgtgtgatgttccccttcctgtgaccatgtgttctcattgttcaattcccacctgtgagtgagaatatgcggtgtttggttttttgtccttgcgatagtttgctgagaatgatggtttacagcttcatccatatccctacaaaggacatgaactcatcattttttatggctgcatagtattccatggtgatttatacattttaatttgaacttcactcacctctacaaagttaaataaagcattccatttccatttcaataatactttaaatatctaggcagttaaagcatgaggttacttggcacttaaatgtactcttgtcatactacttttgttggcttaaattgcaaaaaaaaaaaatggttaatttattgtgacaataccctacatttatctgcagtgatcattttttttgtgaaaatggccttcgtttatctgcagcaaaggaaaaagaggatggcaattagttcttgcattcttattcctctcttgggtcctgatccttctcattaatagaaacatggcaggggaggggtatataacccacaccctttcctgttgtggttatgtttccactgttgattctgcttcaggtgaacctttaggattaggcaaataaatttccgtgaggccaaatctttttcttcctcattaacagatgatttctctgctaaaaacacttacgacatggctatactattgccggttttatagttacaggctctaaaccttgaaaacttcctcaaagtctaatacgtcaggagcaagcttttgtacaaaaaatgtgaagacccttaatcagttccaataacaaaataaatccattttaaaccctatcccaagatactgcaaggccttggagcagctggagagactccttaactcttgacattaattaattaatttaaaaattcatatttgtatgtatcagtgaggtaagagtgcttgaaatataatgagatgtgtcacactgtagaaaggggagtgacaacagaaagccctggctggtgaggccccagcacttctcacactcatcagaaggaagtctttccatgaaggcagtagggggtccctggtcccaggccaggtccttcaacaatgctcactggttaacaggaaaggcactacagtggcatcattgttaacatccaagacagtgatagaatgtgaaacttctactgtttagtatttagtattcagcatttagatgttaattatccattttgtgatgaagttccctttcttctccctctcttaaccttttggtagttttattgcatggttaccatttccagttagggttgtgctttggggtctgaactgatgaaggaagagaaactctagttcatcatttctaggaaaaagagaaggctaacatcaattctgatgattagagattttttgattacctatgtcctgcattttaacagaaataaaatgttaattacagtaaacttactttaaccttcttatgctatttaacactcttcaagaaaggacttttgcttgaaatcactacagagtataccataatcttgactgtcatactctgaccaagaaaccagaactatttaggcatatttatgagagtaagtaccctaccgctcaaaatggaaggcttcaacatgtattcctaatatttcctaaaacttcactgaatagttttaaaattgaatataactttaccttcagagagaaacaagatttcgaaaggaaattgtagcagttttgtacttcaattgtcgattttaagattgtggtctgaaaagtatttgaacagtcattctttcttttccactatctcaggaaaggctctcattctattagaagcaatcttagaagcgtaactgccaactctcttcttaaaaagtgaagagcagatggagttctaccaatctgctatacttgacagtttttcaactacctaacctaagttccagttactgtctaaattatttttattcgaataggaaaaatacatttatgcttactgtacatttcgacagtgttcattctttgaggtctgttatttaatctccttcccacttttcttttctatcttaaatcagatgagtccccatggtctggcaacaaaacagctgtttctcaaatttttaacgtctctgtggccctcctcctacccttccaagtgttttccatactatttttctgttgtgggcttcagaattggatgctgttccataattactggtcttcccatgactctgtcacatcataaagtctatatatacccttttcctacgtttacatgccaaataccaggtgtgtctagctttaattcaatgactagcatatggtaggtattgcactaatattttttggtcaagtgaacatatattttacagatagatcaaatacatcaaccttcccatgtaataataataataccaagaagattaaatgatcgcgtgcttgaccagctgtttagtggcagaatctggacccaaccccacatctcctgagtttaatttcagtgctcttcagcattcttatatatctcaactttgttccctgctgagacacagctgacagatatatatatatatcttcacaatctcagtagtaagccctatttttttaagattacagtgctgatcaaagagggatattctatggcattgatgcaaatcttccaggccagatataacccctatctccttaaaccctcattcttgactgtgtcttgaaatcaaatttgagaacctctgctttacatgctaccttcctcttaaaattcataaggtttattccttctctcatcttcagtatttttatgaaaatatgttttactcttatttccaaagtgcttgccagcccatgctgagttcattagacaaacaatctaggtatcctaatatttaggtaaaattgctagcagcactaactataccagtacccacttaaattgcaatataaacctacaataggaaaaaaaaagtcaaaattatactactttcaattcctacttctggaataattatcacaccttcaaaaaaactcataattgttctccaatattaaaaaccaggaactaaattacatcactatatatatatagctatatagacatataactgtatatagtttatatatatattacatgtcactatatatggttatatatacagatagctatatctctatatagtttttatataggaaactatatatataaactcatatatatttatatataaactcatatatatataaactcatatatatttatatataaactcatatatatttatatataaactcatatatatataagagattttatatgtatatatgagagacaatattgaaataaaacaaactagccaatctccaatgtcccttcattttcccaggactcttctttattctcaaagaaatgtatgaatacacaatataaataaatgttctataatgttcattatggattataatagttttcttgtcatactgaagtgaatgggaattgtttcttcgattattagcatacttttcataactatgtgatttggtgataggcacttttgcttactaagttcagcatgatcaaaacagaactcctattatttttattgttgattcttatttctttaaggtaaaatatgcccttttcctttgaacctgcacactgtttaacaaataagcacataactcaggattgaattgtacacttcgatttgagcttttttttcaaggtcaggacccagtttcacaagaagttttattttttccaatacaactgacatccactcccaccagctgaaagacaagaaaaacttgtctaataaagctttcagattcaatttgctgcctgcatacagcttgaggaatctctggaggtcactcacagcatgtgttgcaaccccaacagggagaagtaatgaaaagattctagttaaaaagctgacactgccccttccaacctctttgaatgtgaatataataagccagtttacagacgcaaatctctatgattctggggatttccatcttgatctctgactccaaggaacatttgaatgcatggatttgtatccattatctgggtgaataaatgcttcatattgaaaaaaggggtgctttaacaacataagtctgatgtaaatcaggcaaaacaacattgtcacttcatgtttaactctcctggagggtctctaaggtctcacagtttggttctattccagtaatatataggcctatcatagccattttcaaaaataatacctgctttcatttcgattattccccctagcttttgcattgacccgaacatacctaatatttatcttagggctaacacgcattaatgccttgctctgtaccaggcattttgccaagtattctttgtgcatttttctgtttaatcttacagcagccttatgaaataggtactacattattattatttttcaccatgagaggaaatgaaagcctagagagaatggttatccaaaaacacccagctactaagtgggcacagcatggccttgaacctgagtctttataaagttcatgcctgtcttttacctttatgttaaacatactgaatcttggtcatgcagtctatgaatgaagactccatatactctaggaccaattctaccatattgtgcatgcttttgtacatattttccaaatgaaattaaacaacaatactctctcttcccctttcttttccgttttgcatgacatctaaatcttttattaaatctccgtgggtggaattgggccttaagtagtagtacctttgaagcttaatactataacctcagagttacggaagtggtttcaatatgaagaaatatatacgttcttttcttttcttttcttttctttttttggctcctctagaatagaaggcaatcaggagagaaaaagacattaagatgataggcttgattctcccacagtgttactacttagctttatttattctcccacatctgtaactgtcaattcaaggtcaaaaagccagtacagcagcagaattacaaaaagtagatctggaaaatctatagggtaccatagtccagcaccctgctgcaagtcaaaatcaattaaataaatatgtttaaacagcacttcatttaatcttaagggcaccacgactcccttggaaaattcttttttgtgttcagacctgattctctgaaagtattttctagtgttttctttgttcggtggctgtggtgaataagtggacccaattgcctacagcatgaaatcgtagaaatgaatatgggctggaacttcaatcaatcacacaaaccagaaacatagagttcatcacctcttctggaaagcgtccccttcggccgtcaaaagggtagagtttcctccaacatatgttcatacttccctttgcctcccatctgcaatttcaaccagtctgttgctctcgccctttttaggcttcacataccggatttcttcttaggagctcacttgaaaaaagggttgtatgctttaaaaatactaaaagtcactggactagatgataataaaatttctgtaaaataaaaagggagttaacagaggtgttaccacttatcataatggatattgttgacctttcctctagccagtgtcccacttaagcatgcttcttggctggaatttatttttctcatctggataaatctgaagcattatagtaaaacccagtgtgagcaaggccatggatgcaagtggattgagatgaatgagtggatagacctgcgtgggcagaaataatgaggtcagcaataagccataccaagggatgcacactcaaggaataaattggaggtagcagaataactgaacaaatgatacatttgatcagactgtcacatgaatatcaactgaaacaagttatgactgtagttagtgaaccctagagtgaagaaaacaaaatattgaaatccatctgatcaaaaaataataaaattgtttacatgtatatattatctaaaatttcccttaagaatgaagattataaattcccgcagttgaggaaactgaataagaggagaatcaggacagaatcttttctcttcgtattcctagtccatttttcttctaactacagtagtgagaacaagaatttattcaccaaatcataatacattgcaattaggggatgccatttgaatcttggaagacacgatttgaggcaaataaaaaatccatatttataaagtcaattattggtttatataatttactgtttcagcgggaggtataggttagtaatgtaagtcacttcaagaaggttttggtcgaagttttgccaattttttctgtaaaaagccagatagtaaatattttgggttttacaagccagaagatctttgttgaagttactcaactctgctaatgaggtgcaaagcagccataggcagtttgtaaatgcataagtgtggctgtgttccaataaaagtgtgtttgcaagaacaggcagttggttggatttggcccacaagccgtagttcactgacccctgttttagataaatactagtcaatagattccttgtagctaataaagggaatatagattgtttaatgtgtttccctaatcttcttaaggcttcctccaggggaaaaaatatttcttatcatcagcagtgttattaatgcttactcagaacaaagaataccacttacttagcatagaatggacatttataaagccactcatggaaagaataaagagatgtgaaatacctggtacaactcttaagagtgttccactatcatttgaaaaaatgatgagtagtagttatataaaaggactcgagcctaaaacatttgttctcactttggataacgttttcctatctcagcatcaaaaaatacaaagaaaggggataactaggtcttagattttctaaattctcatgactataagtcccatatatttagatattgaagtacccttaaatatacctaagtagaagtaataatttcgatattatgggaaatctaattactgctcatagttctcgagattaaaatgttatacaccacatctcagctttctttgaaacttgaaatggcatacttgtacaaaggtagaatggtctcccaaagcagcgtcatagattagcagaaaagagctatgataatgccacttcaactgactatcatttaaataatgaattagttaggaagagttaaattatatagttacaggcagcaggagatgtcaccatcagggggataagaagccattttccagtacactatttgacttaactggtgcagttccttctttaactgtaggttactcatttgtatccttaatttatcaatatactaatctgacaaataatttattaaggattactgtgtgccctcctgtgtgttagattctagggatacaatatggatcaagataagcgtgattcctagactcctagaaagtaagaaaactaaataactgtacgtgacaaatactaggatgtagaatactagggaagaatcaggaagaatcacctcacccagtctggagtattgcaacagagcgatgtcagaggaaaaattctggaaaaaaaaaaaaaaaaggaaatttgaagatgagacttgaaggataagtaggtgtacctaggcaaacaagtaggggagagtgttccaggcaagagaaacaagtaacagttggaggcaaaatggagcctagcacgttttaaaaatatcagtatggctgaagcactgagttggggttgggaatgggtgaggagcgatgtgtcagggaggacattccagatgatgctggaaatgcatgcatgttcgcaaactgcattttaagacatgttagagaaatcaaacacattttatttgaagggtaattgaaagccactgaagcattgtagagagactagtgacatgagcatatttgggttttagagggattactctggctgaagaataggtaactgattggataagagcaactttggaggctattccagtggttcaggtgatagataataatgacctaaactaaagaagtaataaagggaatggagacaaagtagacagattcaagtgatacttggcacgtggaaacaacaggccctggtaactgattggacataaaatggagagatacagagaacgcgaatagaacacccaggcatttggcttgataaaccgagtagaccgtggtagaaattactaaactatggagtattttagggttcaggggaactgtgagttcaattttagacatctagttttgcaaggccactgaggtaactgagcatatgagtcaggagagaagtttaggctaaaaatatggatgccagagttaaccagcgttatgataaaacaaagctgaagtctcgagggtaagaacacctaaacatctaggctggagaaggcagcaggtaaaaagtaaaaggagaggccaggcacggtggctcacgcctgtaatcccaacactttggggggccgaggtgggtggatcacctgaggtcgggagtttgagaccagcctgaccaacatggagaaaccgtgtctctactaaaaatacaaaatcagccaggcatggtggcgcatgcctgtaatcccagctactcgggaggctgaggcaggagaatcgcttgaacccaggaggtggaggttgcggtgagccaagattgtgccattgcgctccagcctgggcaacaagagtgaaactccgtctcaaaaaataaaaagaaagagagagagagagagagagagagaaacagagaaagagagagaggaagacaaagaaaggaaggaagggagggagggagggagggagggagggaaagaaaagaaaaggagaaaaattcaggagaatggttacttccagggagatggaggcgattgtgctgtggggaacacaagggtggggtcaaggtattagcagtattctatttcttgattggggttgtatttacataaagtgttgctttataattattcttcacactttatgtgtacgttctatgtaatcatctatagataagacagatttcactgtaaaagaaaataaaagcttccaaaagattatcatcacaattgtaacagattcccctggtgcctggagtcacacgccattttcctgcactgcagttgcagctgcagtggacagccctgtgtgagttcagacttgcctttagctgacagcatcccatgtcaagggaatggctcccatttttctactttctatctaagggacttctctgacatcccaggagcccacagattttgtgagctttctcacccttgaagttttagtgagtgagcaaccttcaaccaatggagatgggagcccatggatatatttttaaccactattccttccgggggcaaggggaattctctgtgattctcaggaacatacaaaagttctgtcaaaatacagtccccatggtccataagcattaccttgatgataatacatttgattggcatttcctccccctctgtctcactcttttggtttttcattcttgcttcctagggatcagcttccaaatgagctatctgtacccaagtcctcatccaggccctgttttcaggggacccaaagacaacaataagaaaaatggaactgaaagaggagaagactttaaggcatgaaaaaagttcctctgtattccatactgcatatttaactgcctactcaacagttccacttagatgtctcaaaaataatctcatgatcttttactgctatgaaatgcatgaccttcccctgatatattcctttcttcaggttttgtagcaccacttagctatccagtaacaaaatcttgggggtcattcttaaaaccttcccacctcacccctgctggacatccaccactaagttcagttgatttttttgctcctaaatatttcttggttcagctttcatttttagatttatcctgcatacccctgtacaatctcatcatctctttcctggactgttacagtagtcttatattaggatgatcatagtcttgatttgcctagagaaaacatgctttatgtcattgcctcagagtgactaatagtcccacctttcacttgtaacactatgcaggttattgggttaaataatactgtcatccaaacctaatctctcctcattcatttcttctctcctatgcatcttagctgtgtgaaaattcaaaatataaatttgatgacagacagaactctgtttaaaatgctccagtaccttaccatttatctcaaaataaaaatttcaaaaaaagaaatgatatcccacaggatcttgtatagtgtgaccctttccatttcatcatccttataccagatactgtgaactacttactctcttatctccacattgacctccctcctagttttgttttgcttatgaaagtgcttattttctgttttttaaagccattgcacatattggtctctctgattgagacactatccttttgaatttttgacctcatacctactcacttttcaggtctcagctcaaatgttatactcaggaaagacgctccttacctcccaaactaggttagtgtaaatggcactatttatactcctcttccagagcacacaccaaatcttatatttatttgtgggacaatttgaattcatgttgttccccctactcaattgtgagcttcttgaggacatactctgcctcctccttacctagctttattgaagtataattgagaaataaaaactgtatgtattcaaggtatacaacatgatgattttatatgactatattgtgagatgattaccacaatcaaattaattaatacatctagcacaagaaatagttactattgtgtgtgtgttgggggggggggatgaggacacttaagatccagtcttgtagcaaatttcaagtaaacagtaaagtattattaactatagtaaccataatgtacattagatccccagacatcttataactgaaagtttgtgccctttgaccaatgatatggtttggctgtgtccccacccaaatctcaccttgaattgtaatccctgtaattcccatgtgttgtgggagggacccagggggaagtaattgaatcatgggtttgtttccccccatgctgttgtcgtgatagtgaatgagttctcatgagatctgatggttttataagcatctggcatttcccttgctggcactcattctctctcctatcaccctgtgaaaaggtgccttcctccatgattgtaagtttccggaggcctctgaagccatgcggaactgtgagtctattaaacctcttttctttataaattacccggtcttgggtatttcttcatagcagcatgagaacggactaatacagtaaattggtactgcagagagtggggtattgctgtaaatatacctgaaaatgtggaagtgacttggaactgggtaagaggcacaggttggaacagtttggagggctagaagatgacaggaaaatgtgggaaaatttgaaacttcctagagacttgttgaatggttttgaccaaaatgccgatggtgatgtggacgatgaagtccaggctgaggtggtctcagatggagattaggaacttcttgggaactggagcaaaggacactgttgctaagctttagcaaagagactggcagcattttcccctggcctagagatctgtggaaatttgaacttgagagagatgatctgaaattggaactttgttttaaagggaagcagagcatcaaagtttggaaaatctgcagcctaacaatgtgatagaaaagaaaaacccattttctgagaaatacaagctggctgcagaactttgcttaagtaaaggagccaaatgttaagcgccaagacaatggggaagatgtctccagggcatgtcagaggtcttaatggcagcccctcccatcacaagcccagaggcctaaaaggaaaacatggtttcacgggccaggcacagggccgtgctgctttgtggagtctcaggacttcgtgccctgcataccagctgtggctcaaagaagccaaagtacagctcaggctgttgcttcagagggtgcaggccttagtggcttacatgtggtgttgggcctggggttggacagaagtcaagaattgaggtttgcaacctctgcctagaattcagaggatgtatggaaaagcctaggtgtccaggcagaagtttgctgcaggggcagggccctcatggaaaacctctctgctgggacagtgcagaaggaaaatgtggggtcggagctccacacagagtccccactggggcactgcctagtggagctgtgagaagaggaccaccatcatccaaaccccagaatagtcagaaatgctgatagtttgaaccatgcatctagaaaagctgcagatactcagtgctagccatgatagcagctgggagggggctgtaccctgcaaagccacaagggcagagctgcccaaggccatgggagcccacctcttgcatcagcatgacctggatgtgagacatgtagtcaaaggagatcatttgggcagttcaaagtgtaatgactgccctattggatttaagacttgcatgtggcctgtaacccctttattttggccaatttctcccattcggaacaggtgtatttacccaatgcctgtaccccccattgtatcctggaagtaactaacttgttttggattttcaggctcataggcggatgggacttgctttgccttagatgaaactttggacttggacttttgggttaatgttggaatgagttaagactttgggtgactgttgggaaggcattattgtgttttgaaatgtgatgacatgagatttgggaggggccaggagcagaatgatatgttttggctgtgtccccacccaaatctcaccttgaattgtaatctccaaaatccccaggtgtcatgggagggacccagtgagaggtaattgaatcatggaggcagtttcccccatgctattctcatgatagtgggtgatttcacatgagatctgatggttttataagtgtctggcgtttcccctgctggcactcattctccctcctgccaccctgtgaagaggtgccttctgccatgattgtaagtttcctgaggcctccccagccatgcagaatggtgaatcaattaaaactgttttcttcataaattacccagtctcgggtatttcttcatagcagcatgagaacagactaatacaaccaacatcccctcttgtcgattttcattgaatccccattacctgggaatgaatgaggaaggcagaaatagaaatcagcgtattgttcaatatagaaatcctgaagttacacaagataattacgagcaagactcagtacagagaaggaacccttgagctggggatcagagtcttctggaaacaaggagtaccaaaggggagtgaaaaagagaagtggagaatgagtagtagcagtaaaagaggaagtatgtaaagaaatggaaataaagatgaaataaactgtcatcttgttccagagacaaagctagctaggggagctaaggaaatttagagggataaaaagtctcatccaaaccttcataatgagctaagggctagtttttcatagaccctagcccaacttgcaaccctctcactctcttacttttttcctggctctgttttgctttactgcctttcatataatctaaaatgatgttaaatgtatatttcctgtctcttttctatatcacaatataaattccatgaggccattgcctgtgccacatttaccactgtactcccagtgcctagaatggtgcccagatcaagtagactcccagagtgtctgttgtcaaatgattctcagtccagtgatgtttgcactacatggtgctgccacttttttttttttttttacttcattccatttggaatttggatcattttgccaactttagggtttattcctctttatttcccctgtgtttgctgaatatctgactatctatttttctcagctctcttctcctcacactttgcctccaacttcctctctgctacaaattatacttagcacaagactggagccacttttcattgattttgatgtcagtgcttgagtgacaactccatgtggagaactttcaacctcctgctgtctcgttgtttgctttgaaaaaaaaaaatactcatcttcttcctgaacccactgggtaaatttatgctcacaaaaaagacaaaacttctagaacaaaaactgtatgagcttcaaaagtattagttttcccttgattttgagactcaaaagtaccatagaaattttaaaagggggatgaagtaattttgtcattcaacccgatatattttacaatttgaatgtcagaaccatgaaatgtcttttcagtgtactatcatcctcactatttccacctataaaagaaaagcaaaaatattgtttgagaacaaaaaaatattgcagtagcggaaaaattcactttaagtctttttttggaggttgccacatcacgcctgtcttcagctcctctcactgaagattctttgttttcttgaaaccagttggtcacttccaattcttaccacctataaatcttcctggttctttatatttcactttatatgtcccttatctcctctgatttttgttccagtctttcattttttacattctttgtcatcctatatgtcagaaagaatctgccactccaaattccttaatatatttatctaccagtgtttatttgcctgtcacatgtactcttcagtaatccattgacttgaaaactttctactctgtctttcttactatagtttgcttcttgagttcaaattattaatatattaggtcaagtaattctatttttatgcacattttacctaacattcttggtaaatataattgttttttaaattgcatcacatggtgagtattaatttaagacgtaattagtattaatctactggacaagattttatttattaactgttttgccctttgctagggttctgtaatctcaccctcagtgcctttaaatagtcttacccaaggatcacctatccctcttcaatttaaattctctattgtgttagtttctgagattgcacattctctggtttggtttggtttttcagtgatctctgtggtcacttccaaccatttctacttagtttacttttttccctgttagccctcttcagtgttaatatcacctggaagttaacccattcctagtctgcattgctctatggccagcatcttggctgattggccatcacctatcctgtacttattgtcaatttttttaaattttttattgtggcaaacagcacataacggaaaatttaccatctgtctttgttcatgtatgttgctataaaggaatgccagagactgggcaatttataaagaatggaaggtttatttggctcatggttctgcaggctgtacaaaaaagcatggcaccactaccaacttctcatgagggcctcaggcttcttccattcatggtgaagggcaaaggggagctggtgtgtagagatcacatggttagagagcataaacaagagagagaggggaagtgccaggctgttatttggcaactagctcttgcagaacctaacagaatgagcagtcactcaacctgcccccaggaagggcattaagccattcaagaaggatccacccccatgaccccacacttcccgttaagccccacctccaatattgaggatcaaatttcaacatgagatttggaggggacaacatctgaactatagcattatcttaattcaaataattttactaccaattccatttattagagaatctaagattaagactactgaaactatgccaatgattatctctagttcaggcttctctcttcaattccaaactcatattttcacctgctgacaagctaccacgtagatgttccacaggtatttctaactcaggatatgtaaaattgatgttatcattattttctgaaaatctattcctcttactatattccctatttttgtgaatgacacaatctaatggactggccatgttaaaaatcaggaagtttttctggcactttctttattccttaatattaagccccacgataaattaccaatcctttcgatcttgttaagacaaataagcttgaaatttcttatctcttatttagcactgcaattttgttttctcattcattcagatagcatcttctacaaaacctcttcactagtttttctgtctctcagctcatcttgtacactgcaaatccattaaaactacactttttaacatgccaatcataatgtattagtaaaggttgtataatagttctctttctcttctaggataaaagctaaatttttcagcttggtacacaaggccgttcatggatttggtacctactagtctatctagggtatttcctacatcttccctcctctctcttgaaaaatcaagtaatactaaactatttgtaactccctaatcaccaattgctgcctttatactttaacatatattcttccttttgctagaaatacatttgtcataataggctctttggtaaacttaccattacattctcagtttataatattatttgtgtaagtaccttttttcctacttagtcctccaggggaatgcatgtgcttctctctccatattatcattttaaaatttactcctatttcagcaagtatcataatattttactgagattaattgttggcatatttatgttaccctggtgacatatttaatagttaagatgctttgggctgcaagaaagagaatgcactttcaaagtggcttcaaaaataagaataattcaactcacataactggaagttcagaggttaaagctggctccagatgaagtacaagcagagctctgtcactctttctctatgactttctttgtcctgatttttttctctgcgtcagctttgacctcctcactagttgccctccaggttccaagatgactgccagcaacaaatgggtaacataatttcttgttacagtgagagacataaacacttacctcacagattcagagatttcaccctcagataagaacaatcaaaattttaattgtgtatctactgtatcattagtatatgtattaggtattcatatatatctactattgtactaaagatgattcagaatggtttcataagctggttgatttaaacttttcttcctgaaccaagaggatgagattatcttgactggcttagaatcgaagatttaggtgaatctaaatccatctccagaactgaggatggattccgtagaaacttgaagacaattggaattctcctagaaagcagaatttcagagtgggtgtagggatatctttgaatggaagttgtttaagccaccaacaatattcactccattggggtgacactgggcccaaaggtacccagttaatatttgttcaacgaacctataggaagacaatattatctgcaagctatttataaactaaatgacaacgagaagtatttttagaaaagttaatcatatacaatttagtcattcacattgggaggctcttcctaaatttcgtttctgatccttatcttgatctttgacgcaatcatatcttggcctccatctaaaagccagtagaagcctctggccattttttaaacaattggtttaacaacattaattggaatctatatagctcaacttaaaaaaaaaaaaaagaggaactagcttatcataatacaatattgtcaaggcaagtgatacttccatgcagctattcagcatttggtgtattcttggtttctgcagacctaataaaaagagattatctcagcgtcctctaggtttaattttaaaaaacaagaaaccatgaacaatgaaaatgatttcaaaacatcttcactcacatctaaaatatgaaatagctagatcagaggttcttaataatttaatcggtgaagcataactgaaggatttagaaaaagtgcctaaactattaaaagattcttcagctgctgcttaatgttgatatcaagttattttttacactggcaaacagctaagccattccctggtcacatccacttttcagcatttagcgctcctctcaatcatcccgatcacagccccaggaatgtttcatggcatctccgcaataatagtatattactattgggtcctgaattttgaggtagtttatctttcagaaaggatatgaatagagcaataagtccaagtagagtgggctttattaatgatgcccaagattttagacgtatactataatcttcaatcaattttaacaccacttcccttaccctagttttagtctaaaccagtccaactgtgctgtagtctcagataatacaatgttagattttttttttcaagatatagaattgtcgggaaaacttgtatgtaacctataccaatctaaatttcttagcatttaactctaaagagtaaagcttttagcacttcctgtgtaatacaagggcaagtgctgatttctctgaatataattttcctttgttagcacatatgttcactgtttaataaaaataagaatgcttcaattatctccttttgtcaagggcctgagaaataaagaaatatacagagggtcccaatctaaaaatgttttgatttacaatggttcggcttaggatatttttattttacaatggtgtgaaagtaatatgcactcagtagaaatcatacttcaagtactcatacaactgttctgcttttcatgttcaatacagtattcaataaattacatgagatgttcaacacctttaataaaataggctttgtgttagatgattttgcccaactgtaggctaatgtaagtgttctgaccatgttgaaggtaggctaggctaagcaatgatgttcagtaggttaggtttattaaatgcatttttcaatttatgatgttttcaacttatgatgggtttttcaatttatgatgttttcaacgtatgatgggtttatcaggaaataatcccattgtacgttgaggagcacctgtatcaatataggcatttacacaactctcgtactgatagcggcaggaggcagagaagctctaggcagaaaagggatggtccccagcgaaaaccccaccctcaagccaaaaagcctgaaaccgcagctcaaagtgggaacttatatcccagttttcctgctcgaatgttgcctttttctaaaccacccatggccccaccccaccccatcctgtgcctataaaaaccccagactcagctggtagacaggactacagctggacatcagagagaagcagcttgacttcagagggacaacttgatggcataactttagagaagaatccggctggacttcaggggaagattacttgccacccccatccccttttcagctccccttcccactgagagccactttcatcggcagtacaatccctcacatttacaatccttcaatttgttcatgtgacctcattttccctagatgctggacaagagctcaggagccacaagtgtgaatacaaaaggccctttgcccttgctggtggagggcagctgcctcctgtgaaaagacaaatggcccactgagctgttaacgcctaagctgtccgtggatggcagagctaacagagcactgtaacacaccctctggggcttcaggggtcgcagacgcctccacctagatgctgctccagtgctcatgcactccagttcccacctcgtttgcttgcacactccctccagtgaggagttgagagcagtgggctaagtaaataaggcacccctgttgcgagttccacaaaggggtcagggaaatatcctgcttcgttactaagtaggtataaaccctttactaagttagtaattattcagtaataatacttaaatgaaagctattctgttagactaaattcagattatcaaagacacgacagaaaacagctttctcattcatgaacctattatttccttttgtaaaatatgttaaatgaaaatacagccgtcatgctaatttctaatggtagaacatattttgaaaactcctttatgtttggaagattttgctttagtgcagataatcagaatgatgtgatatactaagaaataatttttaaaatgagatgtgacatttctcataatctaaataagaaatggcaaaacattgtcctaagctaaataactcatatgaagtgataaaatattgctttctaaaggtccatgatatgtagtgatttctaatgtgtttaatagcattgatcctattgggtaattgggtggttctaacatgtaaggaaggcctccagtactaatttcatgtactgggaaactactgggcagggatgaatcccttaactcctaagtaagactatcagatcatataaatctgctttttgatttgcaaagactcttaggcatacctcttgagaatattaaacatctactaaattatatgtaaagcatttcagtctaagatttacaatgctcaaaggagaaagattttaaagttcagcattggaatttccataatttccttccaattgtagaattttacaattgagatagcaaataataatataaataaatatgtaagactgaaatcaacataggagtttggaaagaagactgtatgggttaactagagttgtcaacaaagacttcacagaagattgtgatcgtagacattagtaaggaataaaatgggtgcaaaaaaaagtctaagaaacaacaaggataaatttattttgtaaagagtgaaagcatattgggtattacataaagagactggctagtttgacacaatgtgtacttttggggtaagcagtgggaaatcactttctgtaagtaaagtggaagagaattcaggtattggatatggtcatataggatttttcaacctttgttttgcccccatccctatcctaccagtatcatcacagatgttggcaatattcactcacttgcctgaagatagatattcatgtcaggggctacagatatgtaaaggtgaatgaagttaaatagcaaaattcaagcacactagttctgactgtgcaccctctctcactcagaaaagcactttggaatgcgagagtactcttatattgacaacctttagttggttctaatttataaaaaaatataaaaatatttagacaatttggatattttatatctatgccacaacccattgtcaaatgattgagatatcattgtttggcaacaatgaaactgaaatcaactctaagagtaaagagtacgacttttaaagatatttggttaagagtaatgttgcaaggcagagaccaacattatagaagttctcaacctgtgtgctggatatagctaaaatttcccaggaccattgaaagaaattctcaaatccacaaccacctcaagtgttgtctgtgaatcaaaggagtgatgcattacccacaaacatgtagtagacattttttaagtgatgtagatgctactgcaattaataaatgcaaaattatattacaatattactgaattcagaataagttgattttgtcactatttttctcaatctacgcatgctagatataaagttattatatagagacgtaacatttttaatatttcagaagcatgctcatgatattgtaaaccaggcactgttaaaagatcactggattgggaattaataaacctgggatctagtcctcatttgatctcttgttggctatggtttgggggttttgggcaaactattcaaccttttctgccttggtttaattgataaatgatggtgttttcccagataaatcccttcccaacttaatattaccagatgtagcatctatggtttagaatgtacagtataaattaaccttcctgaagatcttcacaagttactataacctatattttcatggcactgaaaactaagtttttgatagcttacgtttttataaataatttacttactcatttttatcataataataaatctgattcactaatcaccaaaatatcatttttgaaaatagatgcatgaaaggatccgaacttgttatggttttatctgttcaagtcacctaattttggtagccacaggcccccattgtcaataggggaagattatccattttagcaatacagtctctgataacttcagcccatatgcccttcaattccacttttacgtcagattgaatgggaatgtgaggcccccagtagtaaactaaccctactttctctttggaaattggtctttctacctagctctttgcctctgttcacgttcttgtattccacagaaaatatatacattaggtgttaaaatcacaatgattaacaatttttaagtagaaatagttattaagtatagcataatcatgcctttgaattagtacaaaagtaggaaacagagctttagtgacttttttcattctttccaccatttacagggcaaaaatgaagaattttaccaattcaaaactatgcacatgtatagtttccaccagtatttagtagttatgtttctcaagatgtataattcctttcctttctgttttctgtagtttgataaaccctagataggagttaatgttgtttcagttaggtttattatttcttttatgtggtttaatttcatgcaataagctagagattttgtaacataacttgataaaaattttctcccttcgtatctttttgttttaaaataatggattaatatagattgtaattttacagtagaggaaatacattttacttttagttcttatctagatatcttaggaaaaaagaaacatcatttttaaggattattatttttctactaatgaaaaaaatagcatgattttccattctggactttgtaattaactttaccttggaataattgaatcttaaatataacttcattgaaaattttattttcaagtaacattttaaaatgcaaaatttgtgtgatctctactaaaaagaactctcacatcccaatgtgcttatagctacaataattggttaaaagagacaaattataaagaagatataggttgtgacattgaaattacaaaatgtggattagggaagtaagcgtgtagagttttgtatgcaatcaaagttaagttattaccagcttaaaaaacccttacgtaagatgtaaagaaaagcaaaaacctatagtagcaaaagcaaaaacctatagtagatatacaaaaggtaaaaagtaaggaatcaaagtatactactgagcaaaacagtcaaaccataaaagaagacaacaaaaaaaggcatatagaacaaaggatctacaaaacaattagaaaacaactttttaaatggcagtagtaaattcctacctatcaatatttactttgaatgtaaatggattaaattcaccagtctaaagatagagtggccaaatggattaaaacaacaagactcaactacatgctgcccataagagactcacgtcatcttttaggacacatgttgactgaaatagaagagatagaaaaagatattttggtttccatgcaaatggaaaccaaaagagaatggggatagccatacttctattagacaaaataggctttaaaaatcaaaaactaaaaagacacaaagaaggtcattaaataatgataaaaggatcaattcatcaagaaggtataacaattgtaaatatatatgcacccaacattggagtacctaaatatataaagcaaatataaagtgataaaaagaaagagacaaactacagtacaataatagtaggggacttctaccccaaattcaacaatagacagaaaatccacattaaaaaatcaataagaatgcattggactttatgctttagatcaaatagacctagcagacatatacagtacatctcatctaacagcaggagaatatacattcttatcaagtgcacaagaaacaattcttcagggtagatcatatgttaggccacaaaatgagtcctaacaaatttaacaagattgaaagcatgtattttatgtaaaacaacgccatcatggaaaaagtactagtgtaaacaaggtttaaatatgatttactgattgtttaaaaaggaattatcttagccctgatctgatgggatttcccctttgtaagcagcaaaaataagttcataatgaagcaactgtaataatacagcttcacagatctttctgaataaacagagttggatatgtttctacttcagaaaccatttactgtgggctcacagcttttccatacactctttacactcttaattttaaacccattcatcaaaaggattaagacaatgagattcaagtccaagacaataggaagtatgtgcatcaaaactgtcatgctaatgctctgaggaacattgttatttcaatagcataatttaaaaccactgaaaccatgttttatttatgattacctttcatacgttcaaaaagaatttgagatggtttggcagggatgtcttaaagaaacaaacaccaaatttttatttgttgtgcttctaacaagcaatttttcctacgtaagtgttacctgttttctccccttgattttgatctcttttgtatggttggtagttgtcgcacttctgggcatagtatggttttctacaagttaaataaaaacataaattgattttgatgtagctagttccactatttcagttagtgtgttttccatacctgcaattcataacatgtttactgacccagaacgttaaaactcaagtttagttcaatacagtcacttcaaaccaacttaagatagcagttacatttccaaggtcattatgaagacggagttcaagacttcagcagttgaatttgtcaagctcatgggtcttttagttacaggaagtgtgcatatttcacataagaaacagcaactctgatgatacattgaaactcaaatatacccaaggagtgtaaaactactttataagcccttaaacaataaatatgccaacaatcctctgcatactttttgtcattttttagagcattcaattgaattatataacatgtgataccaataaataattaactttttatttatttatttagagaatgattcttgctttgtctcccaggctggagtgcaatggcatgatctcagctcactgcaacctccacctcttagtttcaagtgattctcctgcctcagcctcccaagtagctgggattacagccatgcaccaccacgcctggctaattttgtacttttagtagagacagggtttcaccataatgatcaggctggccttgaactccggacctcaggtgttctaccacctcagcctcccaaagtgctggtattacaggcatgagccacagcgcctggcttataattaactttaaaaaatattctactatcgaatgcctgaaaaaatcatattacttctatgtattaaaaacaaactattacgtaaatagaccagagatacggtgtcagagatgagattccttggcaacagtctctgagacaaaaagttgcacacagaaagtattttgagaagtattgttgctatttataaggaagtgaaggaggcagtattgggcagagagaaaagctcatccacactgcagttgctactgaggcttcagcccatgtgacagggacactggagctgggatggtctttcagagttctaccaaattgaggcaaatgggcgagacttttgtatctttgcactagccaagagcaggcaccagggagaaatgcagctgtgatccttttgtagatattattattctggagtcaatgcaaccacaccacaaatactaggaataatattggtagtgtgggtgcatcgactccagaagaggatcttgatgaagcattacagtatccactacagagaggcactggcatattctgcttaccccacaaatattgcaatgaggatgcaagtaggagtagtgaggacataaaataaatcgattattttccactgggccttaatatatcagaaccattggaatttacaggatgatatttattatagtactcaaaaaaatctcttttaaatctccttaactcagaagggaattttaaaaagtccacaattcacctggtctatgaattcccttttaaaataaaatgtggtttaatcaaatttacaagaaaaaaacaaacaaccccatcaaaaagtgggggaaggatataaacagactcttctcaaaagaagacatttatgtggccaaaagacacatgaaaaaaagctcatcatcactggtcattagagaaatgcaaatcaaaaccgcaatgagataccatctcacatcagttagaaaggcgatcattaaaaagtcaggaaacaacagatgctggagaggatgtggagaaataggaacgcttttacactgttggtgggagtgtgaattacttcaaccattgtggaagaccgtgtggcgattcctcaaggatctacaaccagaaataccatttaactcagccatcccattactgggtatatacccaaaggattataaatcattctactgtaaagacacatgcacacgtacgtttgttgcagcactgtttacaatagcaaagacttggaaccaacccaaatgtccatcaataatagactggatacagaaaatgtggcacatatacaccatagaatactatgcagccataaaaaaggatgcgttcgtgtcctttgtaaggacatggatgaagctggaaaccatcattctcagcaaactaacacaggaacagaaaaccaaacaccgcatgttctcactcataagtgggagttgaacgatgagaacacatggagatgggggaggggaacatcacacaccagttgggggattggggggcagagggagggataacgttaggagaaatacctaatgtagatgaagggttgatgggtacagcaaaccaccatggcacgtgtatacctacgtagcaaacctgtacattctgcacatgtatcccagaacttaaagtataatttaaaaaatgtggttgaaaaacaaaacccacataatacaaactttgccagcttaactgttttatgtgtacaaaccagtagtgttaactatacatacattgttattcaacagatctctagaatgttttcatctctcaaatccgaaactccaaacccactgaagagctcccattgctccctgtaccccagcactggcaatatgaccactctactttctgtctctaaagagtttaactactttagatacatcatataaaaggaagcatgcagtatttgtcattttatgactggcttatttcacttagcataatgtcttcaaggtacacccatgttgtagcataggaaaggatttccttctttttttgtggccgagtaataatattccgttgtgtcctataccacattttttaatccgtttatcaatcaatggacattttagttacttcaatttttggctattgtgaattatgccgcagttaatatgagtgtgcaaatatctctttaagatcctgtttttaattcttttggatatacagatgctcattgatttacactgggattacatcccaatcagcccatcataagttgaaaatatcatgtcaaaaattaatttaatatgcctaagctaccaaacatcattgcttagtctagcatactttaaatgttatcagaacatgtagattacagtacatctgggcaaaatcatcttgcaacacagtacatagtagagtatcaattatttatcctcatgataaatatcatgctgcaacccaatatgtcagaagagagtatcatactgcatatttactagccctagaaaagatcaaaattcaaaatttgaagtatggtttcttaatgaatgcatatcgctttcacaccattgtaaagtccaaaaattacaagttagaccttagtaagttggggactaaccgtacacccagaaatgggattgctggattatatgataattctatttttattttttgaggactggattatatgataattctatttttatgttttgaggaacttccatacggttttccatagtggctacaccttttcacattcccaccaacaatgcagaagtgtttcagtttctccacatccttgccagcacatgttattttctgtttatgatcgtggtcatcctcatggttgtgaggtaatatctcattgtggttttcgttcttcatttgcatttccccgatgattgacgatgttgagtatgttttcagatgcttgttggctgtgtatatattttctttggagaaatgtctatttaaatccttgcccattttaaaatcaggttaattgtttttggtgaattccttattaattactcacctcagagcctttcttcttaaaatacagatttctcagaacctttcatctaatttactaaatgttgatcttgaagaagtattttaatttatctgaatttagtttcccgttctataaattgatagtaatcatgttttccctatccacaccagagtggtatgatgaggaaccaatgcagaaaatgactaaaaaggcatttttatgctgtccagatcttgtgcaaatatattataattgatttgaaccaaaagaatctacattttaagactatttaatattgtcgcatttacattgcactaatggttcctcttttttctcactgatgaagttctagattgaaactctgaggaaactgtaaatcacagttacataactctgttatattaatttatataacttctctgtctctctctaaatatatatatttagactatatatacatatgcatatatatatttagagagagaacgagattacacttaaggactctgcttagtacattgcaacttgcacctcattctaattgtgaaaacaacaacaaattttgattgagaccctgttatttttcagacctttggtcttgtgaggaaggaaaagatgattctgatacttatctcaaatagcttatcatctcctctggtggatgaggcttgtgagggcctgacacatggtagaggatcttattcattatataacaactttcaaaacacatcactaattatttttctgcttaaggtgaaaacgtagctctcccaaacaaataagagatttagactgaattctgtagaaaacactgcttacctcattttgcttagttttcactgcagagtcttgtctctaacattcaggtaggaggaactctattttaaaaaattgaataaacaaacccaaatcagaataaattatttaattcaggagttttttaaggtgctcagaattttggtagaatagcagtgtattttctgtaataagaactacacaatgttctctagctggttatactcaaatggttatatggattttattctgatatcagttttgcaattgatgaccacccttcatcaatagcgtggtctttattatggtttcatctggctttttcttcccttgtcttctgcactgggctgcctacttcttggctcttattattacatactctacttttttcatatacaaaggtcttagtgcattaatagtgagtttctgctaaaagtgttactttcttcaaatatcctgtcaaatgctggctgcctgatttattgacctcatagagtgactatgtgaatcttccattctctgtggaattccattccacattttaacttaaagactccgtcttttccagctgtgttctctctgctggataagcatttttcttttaatttctgtggtaatgggaagggaattttaaatcctgttttgcgtacaagtgtttaacaggtaaaaatggatgctgtgtcagctatctattgctgtgtaacaagctaccccaaatgtagagacttaaaataagaatcattttttttttttagctcatgattcttgattctgcttggggcttggttcatcgaggcgattcttttgctagactcagctgtgctcattcatgcactcgtggtcagctggtagttgatgaccacatgtggcattcatatgtctggtataactttttggttataagttgagacggtgtgggtgacaggatcacttgcctgtaattattcatcaggctagcatagttccatagcggtggaagagttccaagcatagcccaacacccaagcattgttaagcctctgcttatgtcatgtttgctgatacctcattagccgaaacaagtgacttgaccaatccatattcaaggagtggagaaacagactatggctcttaatgggagaatctggaatatctcttgacaaaagtgtagatgcaagaggagaatctgtggacatttactctccagcagagatgttgtcatttttgtcactaagacagttcctgtgtaatattatttattattccttggcagccataagtttgtggtttacttatggatacttcagtgcctgcccaatatcatgttggaaagagaagcccttaacaatttctcttaatttctacttctgaggaatgagaaaaaaaaaattggataggcataaatgatttccagcacaaattctaagcagctatttgagaggtgggtgggtagggagagatggaaaatccttttaattgagacatgctcaaccataagcaatttttctttcctcaggagacatttggtaatgtcaggagacatttttggttgtacatctaggagggagctctggccagagatactgacaagcaattctgatcctacaatgcacaggacagccactcacgacaaaaaattatctgggacaaaaatgtcaatagtgctgagattgagaaaccctgcttttcactgagcgcatgtagatgaattcatataatgttagttatagaagggcacttagatgatgccaactaaaacaggaaaaggcaatgattatttctctattcaagttagtgaaggaaggatatgtttaaagtcaggttggagatatttctcaagggtaatatttaagttgtgagtggatgccagatgcgcttgattgttacaatccatatttttatagctatatcaaatgatcttctctcccaaattaaaatggatattagatatatttcatggataccatatattataagctatagctcttagaagtatttgagtgattaataattcttgcatattgaatgagacatgtaagaaagatacctgatgtcctatgattcttagaaatatgtgcagtggttaagcacattgtcttggaaacatcacttgttaatgtgagatcctgaacaagtttcgttaccttggtaaaagggggatgataacatctaccctgaagatggtttggtaaaggtgaaataaaagagggtttatgaagaaccttgcctagcacataagaatcactgagtaaatgatgggggtgatggcagtgttggtggcaattatcttacttgtaagtagtagcaaatatttatttggattatatttttaatagcaagaaagaatctattaaaatgtaagcaaatagcaccattaagctttaaaaatccatagctcccaaacttaacatttttttttcttaaatccagaaatacaaatggttatcatgaatccttgagttccagtactccggccttgcctatgtagagtacaagcatttatttttctaaaatgagaattattgatgttaggtgtgtcatatattttatttactctttagagtgacagaaaagaaagcagacaaaaataagtgtttatgtgttcatagtgtttgtttctaattttccaacttgtatgtgcagactgtaaatatttagagggaagacatgaaattcttccttacctacacaatagattgtctttcttagaatctagacatgatttcaaattttcttcagaagttctcttgaattcttacggaattcattaatccaaatgccatcctttcaaatattcaaaaagaaaatattctccaatgttgcttacatggaggagagttattttatctactagtgagatggaagtcgctaacaatctttcttataccccatagtattaaatagtaatgcaatttgatcacatataacattgctctcctgttgacatggaatgataaggaggaagggaatatctaacagcactttttagatattctctcatagaattgttaatgtgagcccaataacttattttgtaagttgagtgatttttcaaatataaaagtgaagcaaacaaaaaaagttacccacattcattcaacaaagctagaaatagagtatgtgcttcttgctttcttatcaaccaaaggagacctgtgaattacaggaaaaccatgtgtgaatacttcaaaggaaatatgccaaacacattgtgtgtgtgttttaaaagatttagtagctcctttaaagctctaagtaaagctgttagtctgactaatcatgtacccctgaaaccaattaaattttcagactagagaagtgttcttcaaacacttgaaaaaaataagagttccttcctaaagccaacaccttttaattaacaaaatactcagagcaaagctgtggtttgcaatagtatattacacctactgttattcatgctaccattctggtgtgccaaactcaattcatttcaactattttgagcttgattttctgtctgcttaactatggagggaaaaccacaattttagtagagtcattttaattttctaatgaatgcatgagaaaggtattatgctacatagtatgtcctcagactattcagatgccctctctctctcttgctctgtctctgtctgtctctctttacacacacacacacacacacacacacacacacaatgtgtgtatctatctgtctacctagatatacagtttaattttgtacattgtaatacatctggttctggcataaggtgattgagcaaaaaacaaacaaacaaaacccacccaaatctgttactggaggaacctttaatagcataacatcagaaagactattttcagtaaggaccctaggcaggaaaagacaattcctccaatggacttgagaagaatacccttagtctctgaggtggttagagaggctgagatctgaaccagctaataccagagccagcttcttgtaacccaagataggggcataagaaacggggtgaatgcccaggcatgaacagacttggggttaagattaaatagggtacacgggaaaggatttccgccagctggaggggaagccatttcccatgctccttagggatgacaacaggagacccagcccagaacatcattgaaaattctatgtaataatttatatatcctaactctttacccgttcgttctagattatggattcaggcactcttagcaaaacaaatcctctttcagtcttttaaaatattgacttaacaggaaatatccttggcacaacaatacgaccctgcctgacccttagaactgtgaacaggttgctcagactgtacaaaaccactaacaaatctgaccagcctacacttcactgaaaaaggtgatttgcatatatttctagtactatgacatggtggaaaagaaagaaccgcatatgtgttagataaaggtaaacgcatctgaaagtgcagtaagaatcaatgtgatatatacaataaaataagataaataggccgggcatggtggctcatgcctgtaatcccagcactttgggaggccgaggcaggcagatcacgaggtcaggagatcgagaccatcctggccaacatggtgaaaccccgtctccactaaagtacaaaaaattagttgggcatggtggcaaatgcctgtagtcccagatactcaggaggctgaggcaggggaatcgcttgaacccgcgaggcagagattgcagtgagctgagatcacgccactgcactccagcctggcaacagagcaacactctgtctcaaaaaaaaaaaaaaaaaaaaaaaatttcaggacttcaaaacttctgtcctttgaaacactttgattaaaaaatgaaaaaaatatatacatgcctgaatccagaggcaagtctttttagaaaacataaaatattttaagtaatgtttttctgaacagaaatggctctaatgtgagaggtcgatgaagattagcctcttgcttctttatgttttaaagtatattccttgagacccaaagtttctgactttagaatccaactctcaactactatcagctatcctctagacactttcaaaatcctccaaaacctaatagtggtgcaagattttgtccttcctagtgataactagatttaagtaagaaaacgttaaagactaaaaagtgtttaggacccacaagaaaggtgtaattctgttcctcatggagatattttagttacacacttcttattctggtcctccccaaaacacagaaatctagagttgacatttaaagagaaaatgagatttttgtctggaaacaggagagaaaaagttttcaagaagtatagaaagcgtatgaaaggacacaggtttgaaatggcctgtgctcatgagagaatgcacaatagacatgggtgtggaggagcctggaaagaatggagagaggtaagtctggagggtcaaatctggttcagagtacagagcataaaatcccatacgaatgtagaacatgaggagccaataaccattgtgtgagaaatgcaggaaaaagaggaagaaaaaaatccacatagtgtacttacagtcagaacaatcctaggaggtgacttacatgtatgatgtcataaaatccgtaacacaattccattagattggtactgttttcatagttacacaggtgaaaacttttgagggtcaagatgttcattgtagcaggcatagtataattccttacctcaagatgcctccaatgtcagtgaacattacttttccaagattgtctatttaggaaaaagtaaggccagttgtctatgaaggaagtactattataatcgccactttacagaggagtaaatggagattcagagaggttaagtcatctgactatagttacacagctaaaaaaaaaaaaaattatagagcaaggattcaaatacaacaatctggtcctagaaagcctaaatattctacaccctgctttctgattcagagctatttcctgcttttctcccttcgataggaaaaaaaatgtatgtgtgtggggttgggggcaaataaattgactggctgtattttctctctttaatatttgatctttcattgtctgctccaagcagtgggtcttcctccattatcttctcgtgaaaatagctaaaatcacctaactagtaaaaacctaggcatgttttgtgttctagcctccattcttccattctaatgggtggctgttaaattttagtactcattgtatgtagaagacctctaagttcactaaagagcttactgcacattgacttttctttagattcaaagggaatcaattgagcacctcctatactccaggacatgtgcaagatgcaagagatagagcagtgagaaagtctgataaggtttcccctccctttcccagcagtgtacagatagatgttcttcaggtggtgcatgctggagaagagaagaccagaaatactggcctgacgggtctatagatgagattatctgcccatgactggcgcagggatggccgcattgctagacctctccatcatcctctgaatatgcttcagctaatttatcatcccaatggcatatttagtcatcatgaaccattctctctttttgagtctcaggccctggccttgcttttcaatagacttccaatagattccttcctccttccttcccttactgcctggcttcctgacttccttccttcctgccttcctgccttgtcttgccttgcttttcaatagattccctccctccctccctccctccttcctccctccctccctccctgactttcttctttccttcttcctttctgtctttttccaaacgtgcttttcaggaaacagtggtctgcttgttgaagtctgataattctctagttcctcatccttcactttattgaaatttagtgtgacatgatcatttccacctcattaggtacttctttcatggtcagaagtaagtctggagaaaaaaaaaaaatctcttgtctctgctcttatttgagggtcaaattttcaataagtcactttttaaaaaagcattttctgacacttcccataagcttgaaatcctcctaaattgctgtatattgcctcagtataccttgtgtatctattttaggaacactccatccacatttgccagtcagcctggtgttctgcagttagttcctacagtgatattttaatttagctctcttttcatcctcacacatgcatcctctctggatatttagctcctttcctggaatcccttttaagatttctagatctttttgcttccatgatttcttctcctggactgtgacacaaaatgctatttcttctttacattacatttaattctttctagaaagagcctcagagtagtcagatagctttgagaaacaaaactttttctttattgcctcactgttactgcctttcaatcattgtttcgtgacacaaatttttttattctctctgacaattaaaacactatttttttctgtctgcattgatcaaaattagttccttcattcatagaaaactcttggtgtccctgagaagcttgagagacaagaaacattcttccattctactcatcttcttctctaatgaggagacaaccttaaaagcacagttacatagccataaaaattaatgattggctacctcagaatgaaaattcaatgtctcatttttttttaatattcttagaatcgttcactggttgtccagtgtgagtctcctgttgagatgtcttttgcagctttccttgaaacctttcattccaaactacatagtccaataattttgccaccaatcttctggttatattatgctcttgagtctgttgtctataaacttgattaggcattccttcccctcaccactcacctctgataacccagctgtgtgttggtatttagtatcaattcacaccagcaagttcagccctcttcaatcaatatagggccacacacggacttttgactgactactccccaagtatttcacattttggggccttatctccagtttctcaccacagttgttcatcactgtgtttcttactagccaggcgtttataaaaacagtaatacctaacactattgatcacctactatagtgtcaggcgctgtaataatattattgtgatgatgatgattatgctgctctttctggcattgtcatacgtgtattgcttgtactactcactgaatctacacaactgcccttatgacatttaccctgttattattcctcttttaaggtaaatacatgaaaaatgcttcccactttgccttgcttactgcttattgctagtactgaacaaatgttagaactgaaacttagagaggttatgtggctttaccaaggtcccagagttcctagggcagagaacaggattgtctaccagacattttaattctagtactatgcatcttaaccattaccataggctgacttactctacagtgtccaacactattcatattaagatttatttaatgactttgaaacagtatttcatgtctaaatagaaaaactactaactcgcatttttaagaaaatattgtatcttggtttttcttcactgctggccagtttactaacaatctgaaataaaaagaaaaaaatatgataaactgctcccagtataaaatacagagctaagacaagaacgtttcattggctttgatttccctagggtccagcttcaaattaatttacttcctattcaagggaattttaaatcagaaagaagatcttatcccatcttgttttgcctttgttttttcttgaataaaaaaaaaataagtaaaatttatttccctggcaaggtctgaaaacttttgttttctttaccacttccacaatgtatatgattgttactgagaaggcttatttaacttaagttacttgtccaggcatgagaatgagcaaaatcgttttttaaaaaattgttaaatgtatattaatgaaaaggttgaatcttttcattttctaccatgtattgctaaacaaagtatccacattgttagaaaaagatatataatgtcatgaataagagtttggctcaaattgttactcttcaattaaatttgacttattgttattgaaattggctctttagcttgtgtttctaatttttctttttcttcttttttcctttttgcaaaaacccaaaatattttagctcctactcagactgttactctggtgacacaacctgtggttactaaggaaactgccatctccaaactagaaatgccatcttccttgatgttggaggtacctgctctggcagatttcaaccgggcttggacagaacttaccgactggctttctctgcttgatcaagttataaaatcacagagggtgatggtgggtgaccttgaggatatcaacgagatgatcatcaagcagaaggtatgagaaaaaatgataaaagttggcagaagtttttctttaaaatgaagattttccaccaatcactttactctcctagaccatttcccaccagttcttaggcaactgtttctctctcagcaaacacattactctcactattcagcctaagtataatcaaggatataaattaatgcaaataacaaaagtagccatacattaaaaaggaaatatacaaaaaaaaaaaaaaaaaaaagcagaaaccttacaagaatagttgtctcagttaaatttactaaacaacctggtattttaaaaatctattttataccaaataagtcactcaactgagctatttacatttaaactgtttgttttggcactacgcagcccaacatattgcagaatcaaatataatagtctgggaattgattattatccactcttctaagttgtctgtgccaatttgccttctccaatgataaggataattgaaagagagctataacttaaaaagagaaaagtaacaaaacataagatatttaaaattaccctagatcttaaagttggcatttatgcaatgccatgttcaaatgaacatgtttttaatacaaatagtgcatttttcagcctcagtgtaatccatttggtaaaattatgacatcaactagaaacattagaatacattgatgtaaatatggtttacctagctagatcaaatatactatatatcttttatatttgtgaatgattaagaaaaataatgttggaattgttatacattaaagttttttcacttgtaacagctttcaagcctttctaaagaaatacaaagttgtgctgaaggtatttaggtattaaagtactaccttttgaaaaaacaagaagtgaggcagacagagtaaggggaatttctttgtaaaataaacttcaccaattccataggaataaaagtaatttgatagtaaacaacctgcatttaaaggccttgagcttgaatacagaagacctgaattcagtgccatttgcaaatgatgattgtggtcaagccatctctggatcttcgtttcctattctgagtacagagcatacagagtacacattcacattcacaatatagttatggatatggatgtatataaatatatgtaaatactacatatatgtacctaaaatttgttttacttctgctttaaaaaaagtaattatagccacatttttcagaaaaagtaactgaggctcatagatgtcaaattcccagtaagtagcagaacaaggattcaaatccaagtccatttgattcctaagcttgtgttattacttgctactgcagagagtatacgtagcaagtaatatatgtactgcaagcaatacatactattgctgcggtaataactgtaactgcagttactatttagtgatttgtatgtagatgtagatgtagtctatgtcagacactatgctgagcattttatggttgctatgtactgatacatacagaaacaagaggtacgttcttttacaataccatattgagttatataatactcccaggacttttatttaccaaaggaaacaatattttataatgtttaaagcccaggttttgaagttacattgtctgggttcaaagcttggctcccaagctgtgtgaccttgagtaagttattctgcctacctgagcccaagtttatctagctataaaatggggatagttgtactatctgccttgcagtttgtcatcaggattaagttggttggtacatgaaaaatgcttcccactttgccttgcttactgcttactgctagtattgaacaaatgttagtaattatatttggttccaccacgaactctagaaatctaaccaatgatggcatttgtattatgcaaactgtatatcacatcataatattatatggaaatgagagcttgtttccgcttctgtagcctagtctaccattgacatagcttcctgcagaagttaccagataatagattgggagagaaagtccacacttccttgtgacgggtttgtgagtccagcatttagggaagccattgatgtgctcagtagtctccagagttctctaaataaatgtgtccttttcagaaaggactactgatttgatgccccctcacagagatcgtctttaaatataggtcaaaaactaatgtagagggccaggtgcaatgtttcacgcctgcactcccagcgctttgggaggctgaggcaggtggatcacttgaggtcaggagtttgagaccagcctggtcaacatggccaaaccccatctctactgaaaataaaaaaattagctggtgtggtggcccatgcctataatcccagctactagggaggctgaggcaggagaatcacttgaatcctggaccagaggttccattgagctgagatcacaccattgcactccagactgagtgacagagtgagactccatctcagaaaaaaaaaaatttagggggaaaaatcaaaagccatttctgagacacaaaaatacaggatttataaattatatatggtatatataaaaatatttttaaaatagtatatatagcatattatatataatgatatgtaatgttcatatattacatatttataaaaaaatctaatctcccttctcttgcttgctgaatagggggatgctttgcctgcctcttcctcttatattaaaaaataattcttaaagacattgtcagttcttggcttttatagcctcaatcaccaaattgtcggtaaaatggccctaaataatcattaaacaaatgtgtgtgagaggggaaataagaaggataagtaagtatggggaggattttgttataatttcaggaaatcaatatcaattttatgtaaagttttaaataaagcaatcccaactttaatgtttgatgtgtgaaaaattaggcaaaattccaaaagggctttataaactgaaaaaaactttactaacacctatccatttttattattttaaccaacttctattgagctgccactaagtacctgggaaacataaagttgtacaacatagaatgtgcaggtaaaagaggttgaaggaagaaaataataacactatgatagagataaattttaggataatagctaacacatatgatatgccagtcattgatctaagtacttcacgtgaattctttaatgcttacaacattactgtgaggtagatagagaggcacagtaaggataataacctgcctgagatcgaggaagaaagacaatgatgagatgtgaactcaggcagtttggttccagagtcctctcccttaaacctcatagttttcaacttctctgatattgtgtgggtgatgctgttggggctttcttcagggaaaactaagccaggagagagaatggatgctagtgagatattcctgaagaaggaaaaacttaagccaggcattaaagaatgagttggaattacctagctagataaaacgagaagggcaatccaggcagagggaacagactgtgcttttcactgaggtggaaaaaaaacagagtatatcagaggaattgtgattccatatggctgaagttaagggtatatgatgaggaagaaattgatgaggttgaatagagaggactggggctaaataatgggaatcctttgttgccagactgaggaattttgatgatggcctacaggcagtggcaactctgaaaggattgtaaacaggaaaataaaatcatcacatatagtttagttgcctatcaattagagctctctggatgcaagcaacagaaatcattctctgattaaatcaggcagaaagtaaatgtgctgtaattagcacaaaggcattggaacaaaacttacaaaaggaaaaagaatctgagcatgcctttctgggcatgtggctagcaagaagtattccagtctgtttgtgatactctcttttctccatcctgtgtgtaactctgttcaaattttaaagtcttaaaagagagtccagttcaccttgtttgggtcacatgttaatacatgagctagaagggagcagaaaactttgatttaaatccctctcctcccaaagtctcaaaattagggaaaggcaattctcctgaatagaaactgggttctattgacaatagaagaaggaaatgattctgaccaaccactaaacaataattgtccactgaactcagtcaagaacatgtagaataagttggaggatagagcaaataaaggagatttgtaggaggtaattattatgatctaaagcaagcttgttcaactcatggcctgtgagccacatgcgtcccaggatggctttgaatgtggcccaacacaaatttgtaaactttcttaaaacatgagatactttttgtgacttttttttgctcatcagctatcattagtgttagtgtattttatgtgtggcccaggacaattcttcttccagtgtggcccagggaagccaaaagattggatacagctgatctaaagcaacaggttcatctactcaacttcacaacgtgtagacctgaaataaagaccattcatataccaatacctgaaatataaatttgtttgaccatgacacgtacagtaattggttctcaataaatgtggatagcttgatggataatgtgaatgcaatgtgataaggaaacttcatattcaacaaagactggaatgtgaggattataattccaaagcaccagaagatagataagataatgcaatgagacattttatgactcaaggcaaagttagttatgagattcagaccaaaccttagacgtgcagtaattgaaatatttgccacagaaggggtataaggacatgacattcaagtaagctaacctttcactagctttagactttgaactcagaaaacatatttggtgaaaagcttatggtcccctttagtatgtattgcttgattaaagtattattttagaaaatggtgagctgcttccattttgaaataaaaataatttttactaagtgaattatattcagtgaaaaaaatggaagctacaattacaactttaatttttttaagttttaagaatacagccatttaaaaaaattaagcaaatctgcttcattttagacagtagaaaatataccattatcttttagaagaatagagatgtgaaatatgcaaattaagcctttagaagtaaagcacacatgaagttcaaagtttaatttctagaattgtgaatcaatagcagtggatgatttgtactttatagcttagtgtcggagaaatctgattaaaaaatgctttttctgtttcatcacataaacataagtaaaattgctctgaaacaacaatatttgacaagaattagcagttttcttttttgacataatctatcaaatgaagggaaaaatatgtcctgggttttgctttgagagtgattactaaatctgacccttaaggaaaggaaggagagaacaaagaagggaggaaagaaagggaaggaaggaggaggaaagggaaaaaaagaaggaagagaggaaggaaagcaggaaaaaggggaaggagagagaaaagacaaaagaaaggtagcaaggaaagaaaaaaagacaagaaaggaatattaaagaggacaaaagaggagtgaggaaaggaggaaatggaagagggatggtgggagacaggagggagaaaggtggagggggaaatatgaagagaggttcccagcagtggagactagtgttgctatcaacaaatagaatttagatggccatatgatattatttttcataatactggtgtctgattgcctgtgctgagttaattgtagtcttttttttcaattccgtttggccaggtgttcaggataattcaccacaaaatctcaaccactgcacttgtattgaataaagaattgagttggcaaaggcattttatcctccagtaagacctttccagattggggttgagacaaattggccaatctggacaagatgataatagcattgttcaagattaatttttaaccacacattgcactgttacctgggagatttcattatctaaaaattgaatgagcagttttagtgggtatagtgtatatttaaatgggacataattacttgaatgagtttaatttttgttgttgttgttaaggtcaaagtacttaaaaattatgattttttaaaactctgtctatacacaaaaagcatttgaattagctacagaataattctgattataacttttggtgaatagattcagtcaaaatctgattactaaacaacttgtgtagtatagccctggaagaattgatgggacaatgtgtgggtaaagtggcattggctatttaaactaaaagcaatacaaaacagaatgtttcttggttttattctgttgtcacaaacccagcagaaagtggctattacaatagtttcccttattcaacaaatgagagaagttatagacaatttagttaattgatctaaagtcacttagtaaatgtaattgtcctaacataaacccagacccccagacctcttgggaatagataatgtttcttacttcttttctatttcctcagccacccccctcaacttcttacacatctcatttctccatccaaattataacaaaacaaagcaaacatggtttatttccatgggcatcaaatggatttcacgaggttgggtgacagtcatcttagggtgaggagattgattattctgtttttctctttcatcgatcaacaatccagcccttctcatctcatcatttcatttctgcacaaacttgtttaagaaataccaattaagaaattaattaagaaattaatgttgtaatctgtttggctgaagatatttacaaattttgtgctttaattatcttccaacaaatgtacatgtctctggtagacagcttgcgaccatctggatgactgatccatatttatataattttctttctttacctaatgagaccaaatccactattatcttcaacgaaggatgtaaagatatgtcagtgtcagtaatgtgacttattttatattctctggtcataacaaaaataaaccgccccttaaataaaaaggtcatagagttgcaaacacacacacacacacacacacacacacaaaatcatattttctaagtctcctaattacctttttatggaaaatgataccatatgcttttttcttaaagaaactacataaacttataaactatactaaactacacatttcaaagtctatgaatggaaatgtgtatcttattatattttaattcaattcactgtaaacttttctgtcaaaatcttatcaagcaaaactgatccaggatatttacatgaattctgatggaagtcactgtactgtgttttccataaaataccagtgggattctgataaggaagtttatgtttgccattgtgtttaaatagagaattctgggccgggcatggtagctcacgcctgtaatcccagcactttgggaggctgaggcgggtgtatcacctgaggtcaggagtttgagaccagcctgaccaacatggagaaaccccgtctctactaaaaatacaaaattagccgggcgtggtggcgcatgcctgtagccccagctactcctgaggctgaggcaggagaatcgcttgaacccgggaggcagatgttgcagtgagccgagatcacaccattgcactccagcctgggcaacaagagcgaaactccgtctcaaataaataaataattagagaattctatttacaaatttcctttcttggatctagttagggctcctttatatggagtgatttttattgttttcatagaaatacgtagaatctgggtcttctctaactttcttacaggaaagcaatgtaataaggtttttttttaattttctgaaagttatataatgttattgttccctaaagtttaggacctgccttttaggctttccatttcaccataacttttggtccttaaagtctgtaattgaagttacagtgtgttatgatgtaaatttttcttattattacctttaatgttagggtaatgttaactaatgttaatgttaggtatatggttgtttttttcattccttcgttcaacaaattgtctttgaaacccatgttacaaagcactctagagtcaggttgaagactattaagaaaggagaatagaaagagacactagagtaataatttggatttaaatttgatttccttgtgtatgatagtgaataagtgtgaataagatgaggcagtgatcacacatcactattagtaaaagtgtttctgtacctgtatccacacttttatgtatatggttacttatgttaaagtgatacatattatataaaattaacgtatacattaagtagatattttaatagtctgtaattaaatactactagtattttctttcctccttcaagtgcttacttttgatacctcgagttacagtgtcataaagattctttagaaatatattgactgtcttttaagagcttttgatacaatactgagtttacattcatctgttatttattgaacacttgctggtgaaaggcatcagtgttatctgctcttagggaacaaaaattaaaaagggataggccctaattttagagtgtatcctctataagaaaaacataaaagatagggcagtcatggccacaaaagaaaaaagtgttatggtggtttcaatcatatatgtattagaatgaataaatcaactgatcaattgtgatttcttattctaaatatgtgcctgcctttttcatatagatgaaaattaagctatgtttatctttccagggatcttgttgatttttattcaataacttgggagtgaaagttgatttttgcatatgttttaatgtttttaaatttcataaatgaattgatcagtaatttccaaggtagtaatggctgcattgtttttgaaaaaaaaaaagcaacaggatttgattgtgcttttatgatttttaaagaattcattaaaaataatgccacggtttctaaaatgatttgagtcaatttcttattcgatttataaaaataactttgaatacaattttagtaattcacaaatgctttcagttcccttacctttatattttatattctgtgtaaacaagtgacataatatttaagaattatatatctcctatgatttattcaagaaaagaatatatactgtattatttatttcaagaacagaaatgctttgatttaactgtcatcttctctcttcaattatggaagcaaaataaactgtaatgaccaatgtaacccctcccccatatcaagttaatctatgttcaactccagaattatttttgaacactcaaactagaaattaaaaaaaattaaatccatgaagacgatttttgccaaaagcatatagataaattgagttgattctatacttaagaaagtggagaggagagagtaatttggagagagtaatttactcttaatcccatattttttccctaaatgtgaaagaagtagattgtagtgagagggaaaataacctgtagcaacttcattgaggctaagctttctgtcatgttatattatacgaaagtaatgaaatgcttccacagatagaatcagaagtcccctctgagaaattctacataaaaattagcctgccactttaccacacttactcaagtttgatttttttaagttatgtaatagatgttaggcactagaagaggacatttactgggggcaaagatcagtagttggaaagaatgcaagcaggcaagaagctatatataatgagattttacagtacaattgttttctaaatgaaaatgaggacgggtccagacacaatggctcacacttgtaatatcagtgccaggatggaggatcccttgaggccagaagttcaagagcaacctgggcaacagagtgagacttcatctctacaaaaaaatgaaataaaaagttagctggctgtgatggtgtgggcttgtagccttagctactcaggaggctgaggtgacatgatctcttgggcccaggagttcgaggctgcagtgagctatgatagcgccactggattccaacctgggcaatggaacaaaactccatttctaaaaaagaataaaatataaaactaaaataataaataaataaaaatgaggatatattttattttaacatttggaaactttgtaggtgaggaccatgcaaacattcaaggtgtgagttctgaccaaatccaattattaaccataccaatgacttaaggtttcttcacactccttaaagttgattaatataatgattatatagttgactggtatgtcacagcttgaagcctttgagatttattcctgccttttctgtaaaggttgttttgttaattccagtatgtactggtcgtttttgttttgttttgtttttgtttttgttttgtttttttgagatggagtctcgcactgttgcccgggctggagtgcagtggcacgatctcggctcactgcaacctccgccacctaggttcaagcgattctcctgcttcagcctcctgagtagctgggattacaggcactcaccaccacacccggctaattttttttatttttagtagagatggggtttcactatggtggccaggctggtctcaaatacctgacctcatgatccacctgccttggcctcccaaagtgcggggattacaggcgtgagccaccgtgcccggctgccaatatgtattggtctttttcatcaatgattcagtccaaaatcattttgtcctttaactatatattttcttgtaaagctgcttctgttgtcttgaacttttcttttcaaatgtatgttgtcatttgactttttagattgttattttctggtcctcgaaataaatttaaatttcctgtaaaggaaggtgtaatattctatttgacatagccgctaaagatgtactaggtgctttataaatattgttgatttactttatcttcacagattactagttttacttagtatttggaatatgacaacattttatagagctatattcatatatatgtttatcttaactgttaaatgcaatatgattcatgtcttgttttggtcaatgatgaatgaaagtctcctgagaattaaatttactgcatcgatgcaaaaacaatcataattttagacactctaagaattttagaaattaaaggattttttttttccagtttactctgttaagattgtgtttagctatgcgtgacagcattctcactacagtggcttatccagatagtttctttttctcatagagcaagacttccagaattatgtgttccagggtcagtgcagcacctccaaaaccgtatgtcccaactttttcctccaaccccagtcatctccaacatgagactttctttttgttttgttttgttgtttttgtttttgtttttgttttgagatggagtctctgtcgccaggctggagtgcagtggcgcgatctcgactcactgcaacctctgactccctggttcaagggattctcctgcctcagcctcctgagtagctgggattacgggaacgcaccaccacgcccagctaatttttgtatttttagtagagacggggtttcaccatgttggccaggatggtctcgatctcctgacctcatgatctgcctgcctcagcctcccaaagtggtgggattacaggcgtgagccaccgtgcccagcaagactttttttcctgtggtctcaacatggctactctgcctccaggcactatgtctgtactttaaaatggaagaagggaaaatggggaaagtaaaagcatattccagctgtgtcagctcctgtttgtaaggaaaaccagtgcttttctggcagccccacacagaagagtttctacttgaacagtgcattaaccagaaatgtgtcacgtgaccattcctaacttctaaggatcttgggaggattgagtgttttaactgaataggtgtgtttctttcttcataattcaaaatgtgaaaattggtaacttagttataaaaccttgctagtctgaacagaatttggatttttttagctaagaaggaaagaaagggtatcggataggcagctggctatgctagccaagatactcttaataatgcacatttttcttctttggacataagcagttttaacttagctaaatatgatgtgattgttttcctgtcttcttagttctgtttaaatttgtttcagaaatcaaggaaataaaatggagaaaaaactctattattcatgtctatctttctgcctctgaatatttttatgttggagaaagagaaagcagtaactttcataatagcttacatagtctgacaaattctaaacatgtccgttagcatcaatatacgtggtattaggtcatcagtttttatattctgaattattaagacccaaataaacccactgagttcaagagaaagtatacactgagcaataaaaacattaccagttctagcaatgataatcaaacaagaaaacaagtaatatagtctgtttagaataacatgttttaaagatcaagtttttcttccttaccaatgttgcctttcttgtaacacttttttttccttcttgagataggctttcctatcttttgtcacaaaccccaatatttacatggccattcgtagtctattcatagcagcaccaccccatggcccaaacttgtagatattgccctccttctatggttgttctaataagaataaccactcttgtctctcataatctcagctgttttgtgccgttaaaatggaaaataatgagtattaagatactaactaggggccaggcgcggtggctcacgcctgtaatcccagcactttgggaggatgaggcgggcggatcacgaggtcagaagattgagaccatcctggctaacacggtgaaaccacgtctctactaaaaatacaaaaaattagccaggcgtggtggtgggtgcctgtggtcccagctactcgggaggctactgcactccagcctgggcgacagagcaagactccatctcaaaaaaaaaaaaaaaaaaaatactaactaggtttcagtcatatgagatgaataagtcctacaaatctgtacagcctagggcttgtagttaacaatgttttatatttaaaactttgctaagagagtaaatctttttttacctgttattatcgtacatgcaaaaataatagtaaataaggaaggtaagagaaaaattttggaggtgatgcataggtttatggcatagattctggacatgatttcacaggggtatacagtcatgcattgctcaacaacagatatacattcggagaaatgcatggttagctgattgatcttgttgtgcaaacatcatacagtgtacttacacaaacctagatggtacatcctactatacatctaggttgtatggtatagcctattgctcctaggctataaaccagtacagcatgtgactgtactgaatacttcaggcaattggaacacgatggcaagtatttgtgtatctaatcacatctaaacatagaaaagttacagaaaaatattataatcttataggaccactgtcctacatgtatacagactgtgcacatgatagtggtccattgatcaaaatgtccttatgcagcacataactgtaattatctcgaaactcatcaagctgtgttcattaaatgtgtatagctttttatgtcaataaagtggttaagaaatcaataaagtggttaaaaaatattttgactaggaaatatactatcatttctagttgataaaagatctcaacatttccaaaattgtcctacagaaaaccaggttcatcaggtgttcatacatgatcctcatgaaaaggtcaaataagctgaaaaacatgcatagacgttgcctatcctagcaatctatgatgtacatctccatagtaaggtcactgaaaagtcttttaggaatgttagtattgttagctcagtatttctcagtgatttctccatggaaaccatttgtgtagagcatcttgaggagcacagctgagagaacattatcttagttggatgtgtatgtccctctgagtcacttgatttctctacatatgcttttaccaaattaatcttttagaaatcttttctcttcgcactatgtctataatttgtgaagttgttaccaggataacatttgtgcctctcaccatgatgtacctaccagggtccaagcagccattccttctctagagcaactgtctgagggaaagaatttaacacagcattctacgaaatcattttatttataaaaatagattactgctttacatatagtaatttatatttagaatattgattaattattaaaatctgcatgagagctttaaagagtagtacataatatatagcagtttgtactcaaactgtcttctaaaaaggattcactttttgtttgtattctattgtcctattcgttgatagtgttacgtaagtaattataaaacttaaaatctggaaagagaatgtggactcagaatgccatctcttttgttatttcaaatggattagaaatgaacatacatattcattttctttcattacacatccagagaaatagaatggattttataaatatgtaaaagcaaggattttgatcactgataaaaagggaaggtttggtcactaccttatttcattccttttttcttatccttttttttttttttgtcaattatttgatgacatctctgaacatcaccttttattcatgacaagaattgggtatcatggtaaagaacactgttaatataattcagttacttcaccccctcctgaaatatagagaagctttaagactatgtgaatatttttttctggttttcttgtatttgtagaaatagcatgagctttgtttaaagtcaggcatctaaaaccttgccctgtatgttattgacaacctgcacaaattttaggatctattctattacagtttgttcaactgtaaaactaggatagcaaactctatgtcatattttcgttatcagaatttaaaaagcatgttttaagatcttagtaaataataaatctctactctgtagttgaatttgttctatattctttaagaaattccctttgatggttatgccaacctctgtattacttttcttcacactttaactttgcgctgaaatcatagtagtattttacgttatcagtcaaaataacagtcatccttaaaacaaatatgaattttagatgattaaatagatttgtatggaggttcttcttgctaatcatagcagttatccttggtgaaaaatgatagacacttgaaaaaaccaattaatcatgatggctatttttgcatcataaataaagctttcaaatttgagagggaatcaaaagggcaatggtagtatagtgtctcaaagcccctttccaattgatggtacaaatttaaaaagagagagagagagagaaacatgtttcactgtaattgttttctaagagcttccaaaaaagcgtattttcttaatagattcaaatttttcagttggattgaaagggaagtcttggagtgtagtgaggagggcaccttctgttgagaggtgttcagacgacagagtgtgcccaaggccaaagatgagatggttttgcgaaagtcagtggccacaaacaggtgtgtttgacccctgagagatatgcaggaagtctaccccactttaattcttccaaatattctttaccttaattcccaagtacttgataaaggagcaatggggagaaaatatgcacactattatggaaaagttttgacctacactttggagagttttagattaagagcattctagaaatcagtcccaaatgcctagggtttacttacttaaagataatatcatagtttgggtgactgggaagcataccctgagattgaggtgagcatgcagtatgtctatttaggagtgttcttggggtcaacgtgtaggggcagagggagaagttgagctctgacgcagtcttagtaagggcctcagctgaccgttcagggagttcttaagctggaatgacccttcagaagtgctaggaaacgaagaaaggggactggatctttataaccccgtgtcaagtcatgcactggatgtgggctactccaggaaggcaacgaactttagcaagatgattctctttagccacgggaatttccataagggggctgctatggtctgaatgtttttgtccctccaaaatgtgtatgttgaaacctaacactcaaggtgatggtattagaaggtgggggtttgggggggtgattaggtcatgcgggctctgccttcagaaacaggatcagtgcccttataaaagcggctccagaaagcttccttgccctcccaccatgtaaggacacaccgaagatgccatttaacaggagtgggccctcaccagacaatgaatctgctgatgtcttgatcttggaattcccagcctccagaactataagcaataaattctgttgtttataaattacccagtctaaggtatttagctatagcggcccagactaagacaagggctgacagctgaaggctgtctaccagcagcactcctagcagctggggaactaagtccttcatttccaaaggggaatctaggcagcatatttacagcttttcactacagataagctcattatttcaaatagggactagcaggaaaaaattaaattgcccaaaatttagtgggatgctgaaatagattgtggtgtgtaaattggagtatagtgaggagagcaccttcaaaccagtatgtactacatgatattgtttttgttgcaatatttattatatacccaaacacacatatattacttttagaaacacacaccacatatatatctatgaatattttatatacacatagggaaggattgttgatgttatttatgctattttaaagatcgatgttttcatataattatgtattggttatatattatttcttgatataaggtaaaaaaaaaaagcaaaacaaactttaagtgatcactatgaaaagaatcccaatgctgcacatttaggtttatccaactcttcccattaaaatattaaatagtagaaataattgtgaataagaaagagcagattttgaaaaatggaaagaaatgcttaaagacatagcattgttgcccaaccatcattatttaaacatacagtgtttggctttgaccaaattgccttcaaacacttccttttggcccaaaatgttaggtcatatatactaccataaaattcatgatgcttaccatgcattaatttctagtatataccaggcattgtgctatgcatatcatattcaatatttctaatcctctcaaaagtggtacaagctaactggcgtttttcttgttttgaaagggagaaactcagagaggttaagtgacttgcccaaggcaatgccattgataagtgccagattctatcacaggtttattggcaacaaaccatatgtgcgcgtgcatgcgcgtgtgtgtgtgtgtgtgtgtgtgtgtacacatacacgaataacatatatggtataaatacgtggaaacataataaactgcattgagctgcgtttataattagtatttaggacatgtttggcaaataaaaacagtggagattgaaatggatttgcttaggaaaaatgatacattaaaataggctttattatgagtcttcaactattctgtgaaaatagatacccagggaagaaataatagagaatatgaatcttgagcaggcaactgagaacttgtcgaagagccaagataaaaatgtcagagaggagaatattttggcagctcagatgagcccccagagggtgggaggcaatgatctcaccgcagtctcgtatctgaaccccaggtttttgcatctccataaagtaatttcttacacccctcaataatgatcgggcttactctcaatctctcgctctctctctgtgtctctctcacgcacacaaacatgcagaacatttcttgcacatgcataactcataagacgattatgtaaataccagcctttttatttcataactaaattacaaggcctggttattgtttggactgtgaaaaaataattatgtgaataggtgcctcaagatgaaagacaaggcaagattgtgaaattattcatatgatagtaatagtatgcaaaaaataacacaatctttaaagatctttaacgacctagttataaaaccatgctttataacaaatataaccatgaggaaataaaaagaaaaatgtaataatatactccaagaataaagtcaaatgtattgttgaatgtaaggagttggttacacttccttatagtggaggttattttaaaatttgtggcttacgtggtgttatgaattgccctagatcaacactattatgcaaggccaactattaggttatttttggtagataaccacagcaaaactttagtataataggtaaaggttagctacactcccataccctcactctcaggtgttgtcatactccgtataaaaggttcaatcaagggagacatgagaatattccagaatctagaggcaggatgcagttaaccttagagaaggcatcagacaactagaatcttcggattcaatgtggaaacaaagcatagtttaggcattaaatcttgggcaccattccaaagaatacaggttccataacttactatatttttatacctagcaagctagagatgaggaattgctctcaaatattttaaccaaagcatgtatcttaagtaacactaatctcataagtgaaaactcatttctaatattcattttgctcattagcaaggcctctagtgttgactgtgataaaaaatagttcaaatgctggtagaacccaccccaggagactggcctttctgattaaattctaactctatccccacgtgaattcctgacttaagtaactgagttcctgcacatcagaatataagtatattatagatataaaaacatatgtaattaataaatattttaagtgagacacttctttcatctttatggcttaactatatcagacatttgattatttttagcggtctaactacaaaacaaaacacaaagcccacaactaaaaatttctttgtatatattgcaaagaggcaaccatttggtgtcaattcaatcatgagtgaaatgctattatacgagtacatctccctggcttgtatgggggtaatagggcatggaatttacagattcacaataactgagatattcacaataacaaagatatcaatatgtagcttttcccataactttgtgtaatgaaatcctcagtttgtgctgtgtaaaaagcttattgtttacttctcatgaaaatcatcttagtttttatctttatttaatagtctgtaatttgggggtaatacattcgttttgttgatactatgtgaagtggcaagcagaaaattctaacaggaatagataagcaagtatcctataaatcagagtcagtgtctctctctctctcttttaatgagtcagtctgtctctctctctttttccctgcctggctatctatctgtatttttcagttttgctttgcaaataagagaattgtgtgttgtaaaccaaccaacttaccattaattttctctgaattcaaaagcaattacaagcggactcttgagtttgtgctgcctggttgtctgcatataggccagatgtctagaataggatctttatttactatttttaccctcctaatttcatggtaactccaaggtagatgatatttgtaatcgtacactacttgtcagaaatctttctaataacactgctattttataaaaataaacattaattcagtataaaattttattttaaattgttaattcaagcaaatcagtgaggtaacttttacactgccgagcgtacgtgtgtgtggattagtacagccatgccatagacttcacttgtaatcttttctttatattttttatacacctgaaatgttcatcattgtgctgtagaaaacaatctcattgtgtttttaaaagctagagtgggtattgagaaggggaagaggatcatagaaaaagttggttaacatgctacttaacacttcaaatctttactcgatgtcatcatcagcaacattttaaatttatgcttctactagtttgcagttcttttcctttgattattcttatgatacaagcctttccacacaaaatttatgtacaggaattgtgtagaatttttctttggaaaatatggtgatttattacaatttgggcaacatcatcattttaaaaattcagaatttgatttttctcagaatcatcagaaagaataaagcatatatatggttcatgtcaggagaattagaacatgagaattaatatatctctgatcttttaaaatattttcatgtttgtgaatcagcagatttttcctagtttgagatttaaaaaatctagatataattaaaatctcactgatgtttcaccatcagatgattttatatttgtattttcttccacttcataacttgtatagagaagaatagaagaaagaaaaagggaggattgataatctttctctctcagttcttatagcacttcattttttaaacttattacttccttctgcctgctttgtttgtctacatgtttgtatttcatgatttcttagaaatccatctactgccattctgaaggtcatttacctgaaaatgatagaaagcagcatatattcaaacaactgcagagtaattgtctatatcagttatcattgttcattacttttctgttttaggattgaggggctgcctcgccacctccctcacacccccagcatattatcacaaagcctactgattcattcacatccctgggctgaatttgccacccactgtgtgttcctgttgttttgtgtatggaagtgaaaagatttaatttgatgttgttgaaaagacacagaggctaactttcaattttcatatgtagttcttccctctccctctgcaccacctcctttacttgttgagaaaattgccctctccatggtaacaatagaagaagctttcagattttagtagtagttgttgcagagaaaagaattcaaaaagtagatgaagtttaaaaatgaaaaagagagaggaagacagctgggaagaaggcttaatgtttatgagtgggtgtggaggggaagaactaagttgaatgaacaaagctgagctaaggggaagatggtttttctgcatcccagaaggcaataccctagcctttcctgcagccttcactccccaaaagataagagctttatctgaaattcttataggattcattcctgaagagcagcttgtcaccaaacagaaacactgtgatttcctcagggagtcacagtttattattatttttttaatgtaacgcttttgtgaactccagtttccacctcaattcaaatggtcttttggttacagggtgaaagagacccaacaatacacctttcccacttccggaggcctttggttaaaccatgtctgccacaaggacacaggagcctggtatgactggttgttttttgtttgcttttttgcctcctgtgctttctagattgtgagatactgtaactcttgtcgatgacacatagtaccgaacccacccgaagaagtatgtcagtatgtcacattgtgacaaacagcttctcatgctaagtaaatgcagaaccattgtgaaaggtttaataatgcccactcctcccccgccaaagatgtccatatcctaatcccaggaacctgtgaatatgttaccttacatggcaaaaggctttgtattaacagatgtggttaagttaaaaatcttgacacggagagatagcctgggttaccccagtgcgcccaatgtaatcacaagagtcctcctaagagagaaggaggtgatgatacaagcagagtaaaagagagattggaagatgctacactactggcattgaagatgaaggacagggccaagagccaagaaatgcaggcaggctctaaaagctggaaaaggcatggaaaagaatcctcccctacatcccttagagggaatgcaagctctgccaacacattgtttctagcttgtgagacccattttttggactttggacctccaaaattgtaagataataaatttgggttgttttaagccattaagtctgtaatcatttgttacaacagccacaggcagctaatacagccatgaacatttagtaatgactaactttgcacaattttaatacaagcttcttattaaggtttattttttcttaattacaaggaataaaagtggggtctgggggcaatgtcatggtccactccgttttagccatatgaatttgtatttccagcattagaacaaaaggtgacaaatctgaatgtatttgtgtgaaataataataaagcagaacaaaaagggaaaagtgtccagctggaaatgaagttagagaaagatgaggagaagcaagccaattgtgtagttttcccttctgctttttaaaatcatgatttgtttaacccactgaattctattttagaaacaggactgcaaggaagtgttgatggatttggtggcatgagaaccagagtcacagaggcaggaaagtaaggaataagtgttagaataggaagcagagttgcttgggaagagaccttatgacatgtggacagggctagacttaggagtcagaaagacctgagttcaaatgctatcctttagtatagtttgaagtcaggtagcgtgatgcctccagctttgttcttttggcttaggattgacttggcgatgcgggctcttttttggttccatatgaactttaaagtagttttttccaattctgtgaagaaagtcattggtagcttgatggggatggcattgaatctgtaaattaccttgggcagtatggccatttacacgatattgattcttcctacccatgagcacggaatgttcttccatttgtttgtgtcctcttttatttccttgagcagtggtttgtagttctccttgaagaggtccttcacatcgcttgtaagttggattcctaggtattttattctctttgaagcaattgtgaatgggagttcactcatgatttggctctctgtttgtctgtcgttggtgtataagaatgcttgtgatttttgtacattgattttgtatcctgagactttgctgaagttgcttatcagcttaaggagattttgggctgagacaatggggttttctagatatacaatcatgtcgtctgcaaacagggacaatttgacttcctcttctcctaattgaataccctttatttccttctcctgcctgattgccctggccagaacttccaacactatgttgaataggagtggtgagagagggcatccctgtcttgtgccagttttcaaagggaatgcttctatagtacaaggctacagtaaccaaaacagcatggtactggtaccaaaacagacatatagatcaatggaacagaacagagccctcagaagtaacgccgcatatctaccactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagacttaaacgttagacctaaaaccataaaaaccctagaagaaaacctaggcattaccattcaggacataggcatgggcaaggacttcatgtctaaaacaccaaaagcaagggcaacaaaagccaaaattgacaaatgggatctaactaaactaaagagcttctgcacagcaaaagaaactaccatcagagtgaacaggcaacctacaacatgggagaaaattttcgcaacctgcttatctgacaaagagctaatatccagaatctacaatgaactccaacaaatttacaagaaaaaaacaaacaaccccatccaaaagtgggcgaaggacatgaacagacacttctcaaaagaagacatttatgcagccaaaagacacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacactcttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacatgtatgtttattgaggcactatttacaatagcaaagacttggaaccaacccaaatgtccaacaatgatagactggattaagaaaatgtggcacatatacaccatggaatactatgcagccataaaaaaggatgagttcatgtcctttgtagggacatggatgaaattggaaatcatcattctcagtaaactattgcaagaacaaaaaaccaaacaccgcatattctcattcataggtgggaattgaacaatgagaacacatggacacaggaaggggaacatcacactctggggactgttgtggggtggggggaggggggagggatggcattgggagatatacctaatgctagatgacgggttagtgggtgcagcgtgccagcatggcacatgtatacatatgtaactaacctgcacattgtgcacatgtaccctaaaacttaaagtataataataataataataataaaatctcaaaataattaaaaaaagaaacaaacaaatgctatcctgatcctaactggctggctgtctttggggaagttggtaatcttttctgtgcttatttcctcatgtgtaaaaaaatgaatatagtacccagctaggtagagttgttgttgggattaaatgatgactataaagcatctagcccagcttcggctacattatagctgcttacgaaattgtagttacgatgtaaaagagaaaaacactggaaaaggaggatatgggccattttattccaccttcaccaccttttagcttggtgaccttgggcaaattatgcttcattccgtgcttcattttccttgtctataaaagggtgtaagtacagaaccattgaggggtggtcattattaacctacctcaaatggtgtctgtaagttaatatatattgtgcttttcctatgtacaatatctagcacataattacaaatcaaatccatcccatgtgcaatatctagcacataggaaaagcacaataactagttattactcttgttgtagtaattgctacgctgtaggagtttgaattgtaaggcagtggagagtcactgacctttacgagaaagtgtagcagaacatttgagtagatagtaatggggaatattacataaatggatagatattaggggcagatattactattaaaatattacagcatggatatttattaaggccaaactggttaattagttgcatctctcaggttcctaatgttgcttaattttttaacctcccattttgtgctgccctttgtacgaatatttaatgctcccaacacctcttcagtagcacatgtactgtgagtttgttttgttattacttgtgtgtattagcattcctttgtgaaccaaaagcatggaattagctgttgcctctaggctacctagttttgtagtttggattgaagccttcacctcagtaacacctattctgtctactatcttacagaaaacttgtaaaattaagacagatcattaatatagcagaaagagacaaagggcagagaacattgagatactggatattggaaccacccaatagtgttgatttatttatgattatcagtttttgtctctgcctagcctcatgccactaaagtctctgaggcaacaaagaataagcaattttgctcaccttatacaaataaaacacagaaaaaggaatcactagagaaatggtactgcagcctttctgcagggattactgcttatttttaaattacttaaaaggtattgaaattattgttcataatgagaaacctgcctaataaaacagaaaattaaacttaacacttccctataatgtaaacagctcggttaggaacacaacattacagaaaccacttaagaattgattgtacttgttcttggagcagaactagaagctcaccgtttagaagctgtgcacatttccctatcaaacagtacataaagtttccatattcctcagaatcggcttcatttgtgccatgtgtttgcttggaactatgccacagaaagcagttctccccctcaagctgggctcctttcatgccgcagtgcaagtgtgtgatatactggcaccatgtgctaatgtagacccatttttatatgataagaattagtacggcctagggaatagacaagtatgtctaaaatcctccccatagaatatgtcccttcctttaaaagctgtcatactgtaagttccagctgagttaaaggccactgtgctcctatagggaaatatattctattgtaatttttacgttctccaataacagtctgttctttgtttactgaagagagctttcatgtcataaaatggtgttttttgacagagaagcagaatcattgttttattatagaaatttgctcttacaacagcaaaaataaatagctcatctcttaagctcctgatcaatgtctaacacctcctacccccagcaacacttcactgcaagtatattaacactctataatagcaattccactcacctaccaagaaatgatcttcacaaatgatttacagctaaaccagagcttaaacacatagcacccaatcaagggcagatttttatctttttcccagtcatataagttctgagaagaaatagattaatgttgatctcccagacaactgctgagaaaatgtacaaaggatgttgtttattttgaagaatgagacctagttgttaagcactttttccccttatatgtacgtccaaaggtaaccattacaccattttgatgcaaatttaggatatatatttattcatacctctcttctccattcggatgttgtctgtgtgagtgctcacagacacatgcacacatacacacatgcactcctgtttcacacttatttgtaaaactcacaaggatttccaagccattaatatagcattgtttaaggtgaacacatggttgttcaccatccatatgtatcttcactttgtagcactcagaatttggcaaaatcagaaggctgaaacctcatggattaaatatattctatataacatatgtcttaattgctgttactgtaaagaaacctggactagccatatttgactaatttctacctaaggtatttgaattcttataaatagattcattgctttaatcacacaagagtggtttatatgaatgtaattatctccactttatagctgaataaactgagcctgattctatccctatatgggaaacatgaattgaacagctgtgccaattattttgataattcaaatttcacatctaccatgtgaagacagcagaagagggttagggggcttgaattattctgattaactgtgttcatgagtgtaatcgcctctagataatcactcatttcttcacttcacttcccatctacaggtagtatcagcgaatggtaacatctcttgctttgcctcagtttattgatggctgccgttagaaataaaaagcatggttttgtttcagtacttaaatgaataatatcttcaaaatgtttttaaaacgtgaaaaggttgaatgcatttttaacaaatgttttgttagctttgacttttatttttgaacagatgagcacaataccccagtactcctttcctagaaataggagtactacctgaagacttatttcccaaagaaaaatatcaggtctagtgcagcaatacgtattaagggcattgaaaagttatattcacaaaatgtgacatcataacatatgttaatacttcttatcactgataataatccttgaagttgtatttccagagagatctcaatttcttctcacactctgaaagtctctgtttatcctttagagtaggaatgtaagaatttaacaaaacattctgaatgtttaccttttttctaaactgaaactacaatccctttttacccctatatagtaaaatataatattacaagtagaatcagcaaatttgtttaataattctttgggacagtttttacaagcaatggggttgaatttatgttccttgtgtgcagtggagttattatattcttcttaaaaagatgcatgaaggtaaattagaaatgttttacatgttttcatgacaggacatttaatcaaagaggagatacaagaggcttttcttgggttactgcaatttaattttccatttctttcttggaagggacattggatgcagttgtacgaggttaatatttctaacatgccacttttattgtggcattcttctgctctcaaacctctgatgatttcccatggccttcaacatgatgtccttatttgggcatctagtgttctgagccctcacattctggccccagcttcccttctcaacttgatcacagccatcgtaattctgctaactaattacacagctgcccttcccactctttctcaaccactctgctgtattctgacttctacactttagttttaaagctactccttgtcctgaaattccttctcccattaggtcattattaattgagttcatcctctaagttacagttcatgttgctgttcctctatggcaccttccctgaacctggtcccatataaaatcccatctctcagaatcccattagggtaggatatgtggtctgtagactattacgtttgtcatttacatattgtcttctattattgggtaactgcgtgtgcgagcatgcatgggctggcctgaaggtcacctccccaactgcattgaaagttcatcacaagttcaattatttcactagagagtctctttcatgtcatccatgaggcacattccctactgtgatgtgttatgcatacaattatttcaataaatattttctagctctttgattgaccaaagcttaattacctgtcaactctagcctcttgtatctggaatttctacagtctttggatagtatctttaggatgcaaaattaggaggagtatgtaccaggcaaactattacaaataatgccctcaaatagttacatttcactattcatgtcttgtaatttatcttctgctttggtattttagtacacttatgattcaatttgctgtatagattcctctgaatagggacaagagaattcgtcttgataagtggaagttcgaaggattccaaaatgatgttattcaaggtagaacaagaaattaatactgaaaaaattgaggagtaataatccccaaatatgtacatgcgtatctcgttttattgggtttcactttattgcactttgcagatatttcactttttgtaaattgaaagtttgtggcaaggctgcattgagcaagtccgtcgggcacaatttttccaacagcatgtgctcgctttacgtctctgtgtcacgttttggtaatttgctcaatatttcaaacattattattattattatatttgttatgatctgtgatcagtgacctttgatgttactattgtaattgttttgagatgtcatgaactgcactcatatgagatggcaaactttgtggggtgcagtggctcacacctgtaatcctaacactttgggaggccaaggcaggaggatcgtgttagcccagaagtttgagaccagtctgggaaacaaagtgagaccctgtctttaaaatatatatgtagaaaaattaactgggcatggtggcacatggctgtaaggagccctgccagctgcatgggaggctgacacaggaggatcacttgagcccaggaggtcaaggcggcagtaagccatgttcactccagtgccctccagccagaatgacagagcaagaccctgtgtggaaaaaaaaaaaaagacaaacattttttcaactttgattttagattcagggagtacatgtgtaggtttattaccttgatatattacatgatgccgaggtttggagtacaaatgatactgtcacccaggtactgagcatagtaaccgatagttagtttttcaacccttgtttccctccctccccactctagtagtcctccgtttctattgttgccatcattatgtccatgacaacgcactgtttagctccacatgagaacacgtggtatttggtattgtgtttctgcattaattcacttagaataatggcctccagctgcatccatgttgctgcaaaggacatgattttgttcttttttatggctgcatagtattccatggtgtatatgcaccgtattttctttctccagtctgccactgatgggcacctaggctgacttcatacctttgctattgtgaatagtgctgaaatgaggatgagaatacatgtggttttttagtaaagcaatttgttttatttgggctatatgcccagtaatgggatcactaggttgaacgatagttgtgttttaagtcctttgagaaatcttcaaactgtttcactgtggctgaactaatttgcattcccagcaacagtgtatcagagttccctcttctctacagcgtcagcagcatctgtcatttttttgactttttaataatagccagtatgaatggtgtgagacggtatctcgttgtggttttgatttgcatttctctgatgttgagtgatgtggagcattttttcatgtttgttggccacttgtatgtcttcttttgagtagtgtctgtttatgtcttttgcccattttttttgatggggttatttgtttttgacttgttgaattgtttaagttccctatagattctgaatattagacctttgtcagatgcatagtttgcaaatatattctcttattctgtagactgtctgtttactctgttgataaattctttcactgtgaagagctctttagtttaattaagttccacttgtcaatttttggttttgttataattgcttttgaggacttagttataaattctttcccaagtctgatgtccagagtggtgtttcctaggctttcttataggattcttataatttgagatctaatgtttaaacctttattccatcttgagttaatttttgtatatggtgtaaggagggggtccagttgcattcttctgcatatggctaaccagccatcccagcatcatgtcttaaatacagagtccttttcccattacttattttcataagatggcaaacttaatcaatcaatgttttgtgtgttctggctactccactgatcagccattccctcatctctcttcctctccttgggcctccctattccctgagacacaacaatattgaaattatgccagtcagtaaccctacaatgtcctctaagtgttcatgggaaaaaaaagagtcacatgtttgtcactttaaatcaaaagtcagaaatgattaagattggtgaggaaggcatgtcaaaagccaagacaggctgaaagccagacctcttgtgccagttggccaagttgtgaatgcaaaggaaacgttcttgaagaaaattaaaagtgctactctgttgaacacaggaataagaaagtggaacggccttatttttaatatggagaatgtcttagtggtctggatagaggatcaaaacagccacaccattatcttaagcaaaaggctaatctaaagcaaaggactaattctctgcaattctgtgaatgccgagagaggtgaggaagctgcagcagaaaagttggaagctagcagaagtatgttcatgagccttaatgaataagccctctctataacataaaagtgcaaggcagagcaacaagtgctgatggagaagctgcagcaaactatccagaagatcaaactaacatctaagttaataaaggtggcaatactaaacaacacattttcaatatagacgaaacagccttctattggaaaaggatgccatctaggactttcatagctagagagaagtcaatgcctggcttcaaaagttcaaaggacaggctgactgtcttgtgaggggctaatgcaactggtgactttcagttgaagccagtgctcgtttaccattccaaaaatcctagggcccttcaggttatgctagatctagtctgcctatgctctgtaaatcaaacaacaaagactagatgactgcacatctctttacagcatggtttgatgaacattttgagccctctgttgagacctacttctcaaaaaaatgtgtctttcaaaatattactgctctttgacaatgtccctggtcacccaagagccctgaggaatatgtccaaagagaatgattttattttcatacctgctaacacaacatccattctgcagtccttggatcaagaagtcacttcaactttcaagtcttattacttaaatcatacatttcataaaggtatagctgctatattgtggtgagtccactgatggatctggataaagtaaactgaaaacggaaagtcctcaccattccagatgccatgaagaaaattcatgattgaggggaggaggtcaaaatatcaacattatcaggagtttggaagtagttaattccaacactcatcaatgactttgagggtccaagacttcagtagaagaagtcactgcagatgtggtagaaatagcatgagaaccagaatgagaagtggagtcagaaggtgtgactgaatagctgtaatctcaaggtaaaacttcagcggatccagagttgctgcttatggatgagcaaagattgtggtttcatgagatgcactctactcttggtgatgatgctgtgaacattgttgaaatgacaacaaaggatttagaatattccataaacttagttgataaattagcatcagggtttgagaagattgactcaaattttgaaagaagttctactgagtaaaatgctatcaaacagcatcacatgctacaaagaaatcattggctataaaggagagccaatcgatgcagcaaacttcgttgttgtcttattttaagaaattgctacagccatcccgaccttcagcaaccgccaccctgatcaatcagcagccatcctcactgaggcaagagcctgtaccagcaaaaagattatgactccctgcaggctcagatgattgttaccattttttttaggagtaatgtattttcaaattaaggtatgtacattttttagatacaatgctattgcacacttgacagatgatagtagagtgtaaacataacatttaatgcactggggaaccaaaaatattcgtgtgcctcattttattgtgatatttactttattgcagcagtctggaaccaaacacacaatattccaaggcagtcctatatattgtttcatgtctctctttcttctaaaatgtgtgtaggagaaaaaattatatcacttatgttactgggccataatatcaaaagcctgcgaatctgatgcacatgataaaaactggtcttaaacctgtcttgattatcctttgttaatatgccaaatttatagaacaatagagtttcaagaaatgtgaacaatgtagaataactaaaagatctaacgttgaatagctaaaattatcaacgccctttatatcactttagaaatgcgtttgcaaatcattatcaacaaattgtagcataaaattctttttttttcttgactttgaaattgtatttcaagatccgcaatttacaccacattatttacttactggcttgtgaaagtgaaaggcattttcatttttggatgttaagggttttagtaaatgacaagtaaatcaatcctttaagttccgtgtggtataatagcttggaaaggaccatcttaatctttttttcaacacagggagataatttattttaaaaataacacactaatagtagattaatattattaccatttcaaagaagtcaccaaatttggtaggcttaagaggttttttttttttttttgagattactatgctctttttttattttatttattttatatttatttatttattttttagttttttaattttactttaagttctgggatacatgtgcagaacgtgcaggtttgttacctaggtatacatgtatcatggtggtttgctatactcatcaacccaacatccaggttttaagcccccaatgcattaggtatttgtcctaatgctctctgtccccttgcccctcaccccttgacaggccccggtgtgtgatgttcccctccctgtgtccatgtgttctcattgttcaattcccacttacgagtgagaacatgcagtgctaggcttaagagtttttttaactccccaaaatatcaacaaattgaaacattactacaaagaaatagagaaataaatttcactgactgtcttattgttttttaagtttgaatagctaataatgatttcttaaacagctatcatattttttatttttaaagctagccaaatgatcagtgatttttataatactgataaatactgcttagaaaaggaacatgtgttctagcaatttccacacatttctgattctaattacttgtttctttttgttttatttttatatttttaagttttgtgagtacctagcaggtgtatatatttatttggtacttgagatgttttgatacaggcatgcaatgtgtagtaagcacatcatgtaaaatggggtattcaacccctcaagcatttattctttatgttccaaacaatccaattatactcttttaattaatgtaaaatgtacaattaaatcattattggttatagtccccctgttgtgctatcaaatagtaggtcttactcattctttctaactaattttttgtacccagtaactatacctacaccacccccacctccccacgacccttcccatcctcaggtaaccatccttctactctctatgtccatgagttcaattgttttgaattttaaatcccacaaataagtgagaacatgcaatgtttgtctttctgtgtctgatttatttcacctagcatactgacctccatttccaacaatgttgttgcagatgacagaatctcattcttttttgtggctgagtagtattccattgtgcataggtaccacatgttctttgtccattcatctactgatggacacttaggttgcttccaaatcttggctattgtgaatagcgctgcaataaacatgggagtgcagatatctcttcaatatactgatttattttcttttgggtatatacccagcagcgggaatgctatattatatggtagctctatttttagttttttgaggaacctccaaacggttctccatagtggttgtgctaatttacatttccaccaacagtatacaagggttcctttttcttcacatacttgtcaacattggttattgcctgtcttttggatataagccattttaacgggagtgaggtaatatgtcattgtaattttgattttcatttctctggttatcaatgattcagtgatgttgagcaccttttcatatgcttgtttgccatttgtatgtattcttgatctgccacaagtctctaattacttgtttcttgtaccactgtttcccttcattgtagtcagtgatttggtcaatcaacactttttacgtatgggtatctgttaactgtatttctaggaatggaccaagaattgagaaatttatcccaaccagaaagaacaaaatctatggaggcacaggattactgaaagctttgctcctatagcctcagtttttttctgcaagttcgctgcttcccagttgtccttgtgataaaattcaaaacctcaaactgatttttaaaaagccaactatatactgcttctactatgtctacctaaacttatttgccattatttgtaaagaattccaggctctaaccagcccatttgaggctttattttacgttcatgcctttgttcatgtctgtctttcccttataatgctcttctcattctctagccaaatctgccaaagttcagctgtagtgccatacttgatatgaagtctttgctgagaattcccatatgtggtcatttccttcactgatttgtttcaatagttgttgccattattattattttttttatactgttgctggatactttcgcagatccaatctctaacctgttgttctaccctaggaggttgaccaatatggcagtagcattgggcttgcttgtctattggcttggtccttgtgttgggaggcatcagcagatcaatggatgagaggagagtgagtcgagggatggctaggttcctttactcacagccccagctcctgtcaagaggtcttgtccctgcagccacttctcagattctactaactataccctccccttagcctttcaggccttgaggaggaaagcctcctcatcccactttgaatgaactatttattgcaagaaccatgactgattcagaatataatctgtccttgaatgaaatagttaatttccccttttgtattctcgtttcatatccctgtccctttatccattcctatattatatcatactatcatatagctaccttatattatactatgacatgagtaccttgtaagtatatcatgctatattatagttcttaagtgtgtgggctttggggccaacttacctatgttagaagttctgccacttattaccatgtgatcctagacaaattgtttaacttctttttcattcattttctttactagtaaaataggggcaatattagtacccacctcacagagtaatatgataattacattgactgatagtttttatttaaaacttttattgttcttactatgaaatgggaaatgttctaaacaccttacaaatattaactctattaattctcataatgaatctgagaggtagagactcagtatctccatttcacagtgctggaaatgatacagacagcatttaagtaacatactgaaaatagtaaaccgaataggtggcagccagtatgcaaattgggaaagcctgactccagagttcattcttttaactagtatgctgtgatagactcttttggcatatggtatgcactcaataaacaactattgttgttgtcgttagcattacttcccattgtattattacacaaaaaataattgtttatgagtatttgtttgctagattataagttccttgaaaaaagaagacaagttttatttgtctatgtgtactagctgagtgcttggcaaatagttgcagtttagtaaatgtttctaaaacaaattattagttgtttcttatgtatttcccaagtctatcctagccttggaaacagctaacacttagctaaacctagaaatgtcatttgagatttcagcagccatcattgttgctgaagccacaggttctcctttttatctccaatttcttcctcagatgattcaccactttctttgtcgtttccctacttcatttttcctatagtgacttttgttctccaataaccattgatagtgatgacagtcccaccttggaaccacttctaactgtcctgttcagcttttcctgaggccagatttcccccaaaatacattttttagcttcataactgctccttccagaaatttgaaacgcattctcaggaattaagcaagaggcatttgattgacgtcatttaatttgtgtttaaatgtgttcttcccatcaacgattaaccagtgcttcagccaagatacataacttttattctccactaaccttagggttgaggtcacaatcaggtacgtaatctgtagagcccagtgaaaaatgaaaacgcagggcccttggttaaaaaaaaattaagaatttcaagatggcaacagtagagcatgaaaccaagtatgaatcccttctaatgcagatccttgtgtaactaactgcacaagttatacgttcaagaagctggtcctggttgaggtctttgtctacctagggcacttctcactcagagaggtggaataatcttaactttctgtcttccgtcatctgaaaacttgccccaaagttccttttgccatctcttgcagcaaacctagtggttgttatctgttaaggattcctggtggcttgctttagtttcctacagttcttgagctgcatgtgttgaatggaactccaccattaccatgtaacacatctgaatactcttattttcctccagttaaattctgcgctccttggaaataatggtcatgcaccctaccttagtgatttctaaatagaggtagtatgtaaaaatacatatttacttgaattgcatcttaagaggccagcccatgggaggcatgaagaaacctatgttactaattaatattcaataattgacagttacacattcaggtagtagtgtcatggaaccatcacgttacatggaactgaagagctgatgagaggtttagggtctaggaggacaaaagtgagtgtattagtcagggcctgaggttatatgtacccagacaggataaaatgggacaatattttattagtggaaatatctatgtgaaagaaaagaaggaggaagccaaggaaggtgcaagagatgttagatcaagatgcaattctgactctgcaaggaagagagagggagagaaggctaggcagaagcatcccagtgtgcggtctagtggaaggaaattttggcaaagctgttgggaagtcattgaggcagagccaggcaaagaagtcccatgtctcccaaggaaggctctctgccttagtattcccaccacacccaatcattgggtgaggagaagtctgtgagaagcttggctttggtgcagtgcaatcatggatttcaaaatgcagtaacaggagtcctcagtcagttaagacccaataatagaaggcctgcatattctcatggtggccacttgggtatgaggagcagtggtgtttaaaactgttttgtataatttaaataaagaaaagctgaggactacttaagcttgattccttcagaagacagtctttggcctttatatttcatgtgatatctttgccatatgctctgataactctccatgtttcccctaccataatacctcaggttgttgcaattgcttttttattgcctgtcatcactactcgtttgttttctctttgagaacaggaattattttctccttcactgctacagcccctgcacctagctcaatgagtgacacaacagaagcacttaaaaaattgctataactcaaatttgggggatattctacaaaatacctggcctctgttggtcaaaactgtaagtgttataaagttcaaagaaaggcaaataactatttcaacttaaaaaagactaaggagatacgacaactaaaagcaatgcgtgagtctggaccagaccaggaaataaaaatatagctataaagttcattaatggggtaattgtcatactctgaatatagagtatggataagattatggtactaaagccacgctaaatttcctgactttgaaactgagctgaggttatttaagagaatgtctttgctattaagaaataaaacctaaagtatttaagggtaaaggggcatgatatctgcaaattattctcaaatgattcagaaaaaaaatatatatatataaaacattacatatacagttatatatctatacacacagagagaatgataaaatgataaataattaaaaataatgtggcaaaatgttaacaaatggtgaatccgggcaagggttacctgggagttctttatcttgcaaatattctgcaagcttgaaattatataaaaataaaatgcatcttataaagtatttattcagtgaataaagaacaaaaaaggctaactgcagttggaagatatttatgaagttggttatgaagattcttaagaagttaccgatggaggtgctagtagaacattcaaaaaagaagtagggaaggttgaccaagtaggaaaatatcaatatccaagccagtataaaatggaaatgagaagtgaggaagtaagtggaagacaatgaggatggttttcgatttggccactctatttggagaggcagccgaatgcaagaatagaagccagaagaagatgctcagtgagatggttgaaagctagatagattacagcatcctcaccagtaaaaccctttcggtaactagaaaggctacaatttagtaccttcctgacttctatgcttattttcttcaatacataaaatggttccgtaaactcttttaccttctgaattctttatattaattttttgaagttgtaaataaaatagcatcagttctacattgttacatttcagcttaattcatattcatttactgaaaatgggaacatttgaaaaatcatcatgggcatttatgctatgtagattgttgatttttatagaaaaatataaaaatatgaccagtttgattttcaaagtcttttcttagacatgtaaatactaagcattcaactcaacatatagagtttttatttgagtattatttaggtggaattctattttaatgaatacaataaaaaattgtaattttgtctaaaagcctaaaatgccctagttataatatgtatgatttcactgtttaacttcctatttcatagggttgctatttataaccacttcactcaactctggggggacttagtgagattaaagacttctgattcactttgtatttgaagaattttttttcctccatctttgctcagctagtggaatccatgatgaattctcatctccaaggggtaagcagtttttagtaaagcccagtagctgacttatgactccttagaaatagcattgattccttccttctcctgtgttttgtttcctctagaatgatagaatccatgtagacacgatccattatcatgcttaggtactggtaagcatgtaatgattttagttttgttcgctttaagttatttgtgtcacaaatatctgggatcatatcagagaaataaataagcacaattagcattctacttgtttgttatgactaaagctaggttgaggaaacagaaaaggaccagaggtcatatgaggatgaagataatactaggaacagcatgtttgggagagtaacatctggtaggggtagcagattgggggcagagaacagaattttatagatggatattttggaggcaagtagtttgagtaatgattagatctaaggtgttttctcatctgtgggtggctcgaaggaatagaggtgaaggtcagtttatttgagaagttctggaattataaaactaagttgaagtcaaagaaagtatagtagcaaataaatagaatacccttaaaaggaaaccaaatgaaaaataatcgttactctcaccatatgcttgtgttcttattagcaagaaattcttttaaccactgtttttataatatcttaatgaaaaaatactgaagcgtatgccatattaaatccctctctttatttctagaaagggaatcaaaggagaaaattcccattctgctatactaaaagaccactaagtaaagagcctattagtgtatgataaatcccatagcaatatacattatcattttacagcttctttgttgaaatgaatgtttgtatgtgttgaccatagagtgggataaaaagttgaaattttgttttgaaatattttagaaatgcatagttgtactgcagttgtgaacctccttagatttttaaggaggctgcttcaaaggatctcattaataatcttctcaggtgcttacaaagcatgtgtctgtcagcagaattagagaatcacccaactagagaacaggtttcacaataccctgagacctattttgttcattagagaggaaaatggcttgttttgagtctaagttgacatgcttgctaatttcagcaataaaagctgttcattgtggtcaggtttaatttagagcctggtaaggttcagattaaagttgatcaacttacttttacaacatacttcttaaatgaactttgaaatcttaaaagaaggaaaaaagtatagcaaacagtgaataatgtatctaaaactgagaagcaaaaaaaatctggttatgtgagagtgaattaaaagaagaacaacccaataaagataatctttgttatataaaaatttccaagtatcgaaaagcacgatttttcatgtgagttacacactataccgaatatatttgtccactgccacatgcatagtccctagaatagtgcctagtgctgaaaaatatttattaaaatgaatggatgagtaaatgaatttatgtattttgccagccctgtgtatttaaagttctctgttaactttgaggtgaaaatttgacttcatctgaggtttctgggtaagtccgttttaaaaattctattgaacatattcaaacattttagggtaggcaattccaaagcaacctttcagcttcccatgtcacagatgaccagagtttcacattctaacactggaaaacatcttatttcataaaatctacctgctactatatggttcctactttaaaatttgttcagtactctccagctgacttatgccacttacttcaatagctgtctttggcaatttgttccatatttcaaacactctgttgtgtaaagaaaccataaaagttagaaacctgaaaattggattttttttctgagcaatcacagcttacaaatgtggaaaatttgttaaaagttagcccctccaatttttcaatacagagaggagaaagtgcctaaagtagatgtacaatgtttggaaaagttttttgcattattttactattaccaaaagcaattgagtttaaatcacaaagcctgtctccctacctcttcacagaagaaacactacagaatgatcaaaatttggcctttccaaaaccaaaattcgttagaaaatcagcaggagtcaaagtacagagtaaataactaagtttcatataagtttcagatacattactatctaccactttcatctcttcatcttcattggcctcatgtggtagaacatcatatttaaaattatacaaacttgctggcttgtttactagtgtggttattataagaaaaaaatgagaaaatatagataaaacatctgtcacatattgcttataaactaacagtaaatattacttgtattttccccaattaaaataaaatttactgagttttagaaccagagctagtcagatgcctttttttcataaatttcttcataaatacctctgagattgtggtccttaaatctagagagactaagatgacagagaaaatagacactgaagaaagggaagaatatcttaatgatttacattactacctataaattaaaaattgttaactttattatatttgtatttttatttaaaatagtgctatattaaagtcatttataatacaggggaataggaatactaacctgtaatctgatgctctccaaacttgcctaaatcataaaagttaattagataatttatttaaaatgcaagatttgcagccctttccactacatattcattagttctggagggaggcaaaaaggtttggtgattcttacggacaggcagcttaggagaaaagctgatttagctcgtctacttcaccttttcatttgacaggtgagaaatctcaggggtacaatgaagttaaataagtaatatctcttaaatcggttctgtgctttttctgtttttaaaataaatataccttaattttgacgtcacacagaatgatattataagtataaatagttatctatcttttaaatacattgtcgtaattcagaataacatttcttactcaaggcattcagacagtggtttaagtaatccgaggtactccggaatgtctccatttgagcctttaaatgaagaaaatctatagtcaagattttcatttgaaatatttttgatatctaagaatgaaacatatttcctgttaaattgttttctataaacccttatacagtaacatcttttttatttctaaaagtgttttggctggtctcacaattgtactttactttgtattatgtaaaaggaatacacaacgctgaagaaccctgatactaagggatatttgttcttacaggcaacaatgcaggatttggaacagaggcgtccccagttggaagaactcattaccgctgcccaaaatttgaaaaacaagaccagcaatcaagaggctagaacaatcattacggatcgaagtaagttttttaacaagcatgggacacacaaagcaagatgcatgacaagtttcaataaaaacttaagttcatatatccccctcacatttataaaaataatgtgaaataattgtaaatgataacaattgtgctgagattttcagtccataatgttaccttttaataaatgaatgtaattccattgaatagaagaaatacatttttaaatcaattcagggcttatatagttgcaaagcatgcattgatgggtgtggtgaccacagtgtggcagaacatttgtggcagaacatttgttctttagttgtcatctgggctggcatccatggagatgccagtctctccctcatatccttggctgttggtccaagcaggcagtggcttcttcctgggccatctttcattcccatgtgcagtgactttcagatctggatatctctccgctactttgatgcccccattttgtaatatcaaaaatcatcgtactgtaccttatgccgtagtagggtgggcaggaactttggtaagacccatctgactagacgctgtgcatattcttttcttctgacatacactcctatccatttaatggggagagtgattcgcagtgattgtgtgttgtgtcagtgagtttccatggggtcaggaagagtgacagacgaaggagtaggggaaactcgccacccggtttccctcagagattctcctcagaaatgaggtccaagtcagctctgctttcaggttctctcagatctctctcggtttcttcacttctctctaccttccttccctccagggacacacactggtattgaattttcttgcttcctctgcaatatcccctcattttccttcccacaacccgaagaatcctttgtagtgcaggaaggaggaaaacctttcagccatctttttttttctctttgaaatcttttgtcttttaccaggcttagacttttcaaactcggaaaccatgagagtctatatcttcataatttatattctgctatgttaacccttccctaaggaaatgactagttgtcaatatgttggggaaagtgaaagagtaaccagagtaaaaggttaatattttaaaatattattagtcatacttccacatattgggtaagtacttattgataatagctagtatttattcagtacctcataagcattagatggtgtgtgcacatgtgtgtgtttctgtgtgtttctgtgtgtgtgtacaaaatctttacagaatcttgtgagctatattttataatccccattttatagacgagaaaacaggttccaagaacagttactcggccgggcgcggtggctcacgcctgtaatcccagcacttggggaggccgaggcgggcggatcacgaggtcaggagatcgagaccatcctggctaacacggtgaaaccccgtctctactaaaaatacaaaaaaaaattagccgggcgtggtggcgggcgcctgtagtcccagctacttgggaggctgaggcaggagaatggcgtgaacccgggaggcggagcttgcagtgagccgagattgcgccactgcactccagcctgggcgacagagcgagactgcgtcgtttacaaacaagcaaagaacagagcttggaatttgtaaatgtctctttctgacttgaaaatctgcgctctttctagtatgtttaccatttcccatcttgttttgttgcttttgttaatgaccttaatcattgtactaagactaaatacttcttttgtctgaaattatgtatgttttgattcacttcctaaagacatgtcttctttcagttgtagtgattgctaattaaaataggctgttcttggttttgaaagtttaactctttattgttgcttaaacaatgaatgtggatgtatgctaatgtattatttcagtaacactagccactataacaggtaatctcccaaatcttggaggcttactacagcagaaatttacttcttattttagtgcagtccaaaataagcagccctctatgaagtcattcaggaacccaagctccttccatcttttgtgtccagagcataagactcatatgcatttaatgggcagatgaagaatgagtattactcatgaaaatttgtcatgagccacgcctggaaatggtgtgtgttaattttgttcatattctgttggatggatcttgtcacatggtcacacctaactgcgagggaattagggaaatagtgtacactgttgagcctaggaagaggaacagatttggtaagatagccatacaattgatttagcagagcattcctccaccatactggaaccttgagggttctccaacaagttgcaacacactgacccaaaagagtgaatcttagtgagtgatttactcaatatgagactgaattcccattacacaggtaagtgatcagtttcttgcctgagaaatatggaaatttggcagtgaggtttatgcaaatctgaacatactatacagagagtcatttgttattttactaatgaaaaatcacttcaattttttccctaagaggaagacaatatgaatgtattatacagtatttgttcaacattgtctgaacattttccattatcccctgcatttttttttcatattgcattgactttttcatgatagagattaaaattgaatgaccggagggcaagtttgtatctctctgccaatattcagtgatttgaatagttcttcttttctaagcttttgtcttttaggaatgaatacctttatgaatatttgcagcctagtggaaaggctgtaatccaaatggtccaagaaagcattttcttaaaagcaagtgtctgtcgagatgtgtcatagcgcttattaagagtctaagctggaatcttagttccaaatatgcctggagcctctaaatggtaccaggataattctgacaagatatgtttatctaaacaatgtcatttgcagccctgctacacttcagtttatctctccctttgaaatctataaaatgggatggaaattcaatactcataaacttttcgatcgtgttcaaaatagaatttttcttagtaaagatttggttttcaggaaaaggacagaaataaaatacttgctcataaaattgtattttctcatttgatgattttggtcttcctttttattgccatgaaacttctagaaatgctcaaaaagaaatcagctaaataaagaaaaaatagttaatatatgtatgtaatactatattgaaacatttttctttctctggtaaatcccatttcataactttgaacagttgggaaaatctatacatagttattgcagtctatcaagagaaaagttcagtacaaagctatttatgtctactagaaatattcatgttaaacttcaagtaattgggtgtgcaagccaccaccatgttttactatatgaaactattaccgtggtatctgttgtattcaggtaattatattgatggaaatcatgcagtaataatctaggtaagagagtaaattttgtctaaatcagatcaaatgaaaaattctccctctttctaatattcgaattgctcatttttctttaactctttggtgtctgaatttgtcaatcattcctggccattttcttctgcaaaagggctgggtcaggggaccaaaagcagataagattagaagaatttaaattttcttccttggaggcgtctgaattacatgaaactcttgttcgtgtctgttaatactgcaaggcataataccataataccttgcatagcagtgaagaggatttggaaagataaaactgcttccttttatcattctgtttatttcacaaacaatattggtgaatgtcgttcctgtaacatttggatttaagagccttgtttctgtagcttctccctccgtaacccccaccactaccatttcggggctatacagcaatagcatgcattactttaaaaggcaggctgcctagactggccacttgttagctttgtggccttgagcaaatgactaatctcagtaaactatctgctcttagtttccttctctgtaaaataggctcacttataactatctcatgggttgggaggattagatgaaataattaatgtagagcccttagatcagggccatagtaaaagctgaatgaatgttagcatttgttattttaattataatctattggggtgctttgaaggcttaatgcaaaatacttaatgagctttttggtagctgtttagttatttcgccccccaccaccaccccaaaaggagagatttaaaagaccgacaggagaaggttgcttggaaaagatggaataagatctataaatagaattaaacaaatattcaggaaagccttttgtgggaaatactgcaaaatttttattatctataaatttaataggtagataaaattactactcccattttagagacagaaaaccgagactcggagagctaacgtaacttgtctagggtcttaggaagatgacaagtgaggaagtagaattcaagcccacgtctatatgattttaaagcccgaggcacatcaaatggaaaaggctggttagtcagaaaaataggaaggtatatttatctgacaacttaaaatattaggactaacctcaggtaattatagtctggatatacatttttgctgctcctgtttatacttttgacttctgtgtatttgagtgtctaatcaaaggattgtcttttacatgtgttggagatgtacagactagtggaccccaatgatctattagctgtgtaaccttagccaagttaattctctttcctaaactgtggttctctcatctgtcatgtggggctaataatagtacttatgctggtagggtgattaagaaagtaaaataattggtgtttctaaagtaaatatgtggcacatattagatgctcattaaatggtacatattgttatggtgagatggatttggtacagagagaactggagatgggagaatatgaagggtgtataatgtggccttttattagctaaaccaagggaaggacttctgaaacagaattccaagttttaagagggagtcgtttattttggaattattttttcagctaaggatttttcaacccagtccagaattcttagagaaatttagtgatagcttataaattttaagaaaaggaattcacattatattgcataaagaactggtatacagggccatagaaggggagaatgttcttctgtatgagaataaaaaaaaacatctctcacacgatttttgaattaactgacagttttatagcagctttgtcaacccatcattcattgctgcaaccaaatctatgaaatccttcatggcgaaataaaaaggctctgttgttctccacatttgtatgaaatctctgttgctaatgaaatgccagccagtatcttcctctcaggtattgtctattagatggttgcttattttagaagaagtggagtcaaccatataaatttccttcttttgacatctagcacctgctgtcaacctgttatagctacaagcagctctcaaaattcacatccactaggatgccgctggcaaccaaagagttcagttcagttcagcgaacgtttgaatgcctactctgtgctatctaatatcagagatggtagaggggatacaggaaaaaagtaagattcagcctttgtctttaaagagctcacaatcaaatgtgggtatttggacaagtatatttaggcaaggcagtttaggataggtgcttcagtagagcagtattacaaaatgttgagagaaaactagaggaggagttttaaatgagggcttagtggaatgcttccaggaggaggctgaatttgacctggtcatgaataagactttgaaaagcagaaggaagctggagagggaagggtatttcaggaattgatgacaggagaatacataattagacctgttaacagtggggtggaagacgaatatcagcatgggagtgtgtgtgtgtgtgtgtgtgtgtgtgtgtgtgtgtgtgtgtgtgttgtggaggataagggagtaaatgaagtcagtaagaccagttagaaggcaagagagcccaagctggagcagtgaccatggagtaaaaagaaagaagtgaaattgagacataaggtggagctagaattaacaggattttgacattgattgcatatataaaactgtcaatctaagagaaggcctgcctctaagagttggagattgaattctttggaagattaatgtcataaccagagacaaactcaggataaggagttgattatgggagacaaagtaatgtgcttaacatgaagctagatgaccatactgagattttaaagaaatggttgaaaacatagagattgcaggagtgatgttacttttggacaagaattcaaaagttacctggaatgtctgagcttgcacagagagagggtacctggtgcaaagaaaagtgaacctaggaaaaagcctagaagttggtttacatttaaggaatttgagaagaggtagcaccacccaccccccacacaacccccaaccctgccaacttacaatatagaagcatttagacacacactgaataataattttttttttgagacagagtcctgctccattgcccaggctggagtgcagtggtgccatctttgctcactgcaactccgcctcccagattcaagctattctcttgcctcagcctaccgagtagctggcattacaggctcccaccatcatgcccagctaatttttttgtatttttagtagggacggggtttcgtcatgttggccaggctggtctcaaactcttgacttcaggtgatccacccgcctcggcctcccaaagtgctgggattacagacctgagccaccgcgcccagcctaaataatgaatttatagatgctacactgtatggtttcctttttctgctgctgtacaaccattcaagtaacataagtttcatcctggttcttaatgataccatgaataaagtatagaaactctttagctgaggattaaagattgttgtgtttaggtagaccaggtttctgatgcagccctcagtataccagggaaattagccattactgtttgccttgtaggtctaatgaaccctttagctttttattttgtatatgtctaagttactctacaaattcttatggaagtataaagagatagtgaaagacaatcttatgagaaattttaataagaattgaaatacaggctgggcacagtggctcactcctgtaattccagcactttgggaggctgaagcgatggatcacctgaggtcaggagttcgaaaccagcctggctaacatggtgaagccccatctctactaaaaatacaaaaaaattagccaggcatggtggcgggcacctgtaatcccagctactcgggaggctgaggcaggagaattgcttgaacccgggaggcggaggttgcactgagccgagatcacgccattgcactctaacctgggcaacaagagtgaaactccatcgtaaataaataaataaataaataataaaaaagaaatacaacttactttttgtatcaaataaattttggtgcacaaacatcataaatgacataatatctgtcacacatcctttagcaaaacaggattgttaaaattcttacagctaatattatgtggtgaagttcttcctgttgaataattaagtggattaaaatatcatatttcctttctgtcattagaaatatattgtgcattaatcagtccttgggcctgagaacatttatctaggttttcatcatctgaaaactcacagtccaatatttcacctgtattatcaattcaccattatcattagagtttagaatgctgctgtctctttccatctatcttctgttgtatctaataattaggagatatatatatatatatatatatatatagagagagagagagagagagagagagagagagagtgagagagagagagagattggtaataatactaatatatataataatattatatatatacacacatacagagagagagagagagagagagagagagattgattttaagccattaactcatatgattgtgggagctgaaaagtcaaaaatctgtaaaatccaaaagcctggcaggatggagaccaagggaagagttgatgttgcaatcttgagtccaaaggtaatccgatagcagaattccttccttttctggggacttcagtcttttctcttaaggacttcaaaattgattggagaaggcccacccacattgtggagggtaatctgctttactcaaagtctgctgattgaaatgttaatcacatctaaaaaataccttcacagcaacatctagattggtgtttgaccaaacaactgggaaccatagcccagccaagttaacacataaaatttaccatcatcagccatcatcatgaggttcataatgtcatgtgtttcttcacatataaatctcgtggttcttttatttttttagtagtacctagttaataaggtacctggaaatatacgttaaataatagaaatggtctttaatatcttaatgaatttcagagttctatcagagtaattgtaacttgtatataaaaactgatatataaaaaacaagtatgttttttcttcctatacgttgtgttaaattaatactaattacctatcatgaaatgaatgttttccatttttcataaatgtatttcatttttaaattaagaggattaatatcaaaacatatttgaataggatttaaaatccaaattacctgttgcgattatatttaattataaatctttcaagtgagtttataataggaaaaatattttttattaaagtgatgtaccataattatgaacataaatagtgttttctactaattgtttttgtcttcattatgtttctttttaaggggaaagatctgggttaacaaatgttttattcatccaccttgaaaattaaacataataaacaaaactattaaataaataaaccaattaaagaaaatagtttttcttccttttttgtgataaagatgattatgagtaaatatattaaagaattttatactcagacaaagtgagctaataagacaaatacaaacagagatgagcccagaaagagatactctacatgtttataggctagcatttttatcttatgacctacagggtcattgtaactaaagtcttgaatttctgttatattttggtacctgtgggcataaataggaatattactccctgatggcatcatgcattttagataaaactaagccaagggttaaacacgtgccatggactgttcctaaaaaatgctctcagctctcaagttatagaaaattgtagggattattattttgtacctactacttctttctttaccaaaatttacttatacatgatttgaaaattgcttgccacctgtctttattctgttgtacttgtcttaagtaaaacatttataaagtaagtaggaaggattaatagattgtgacctttctacatgaaaaggggaaagccgagcttgttctacttttgtcaggaaagagtttgaatagttacctgttactgtaaaacaatcaccccaaacttagtgtcctaaagtagcaataatcatttattatcactcataggttctgtaggtcaggattcatgcattgcttggttgaggggttctgtctcacgatcactcatgatgttgcactcagatgtcaattaggctgcagtcatatgatggcttgactggggctgaaggattcactttcacagtgagttacttgtatagcttgtgagttggtgctgtctagttggtttccctctaaacgagttcctccatgggactacttgagtgttcttatgatgtggtggctggcttaccccaggacaagcaacctatgagttttgccctgagttttctgaaacatgatcccatgttgctttgaatatccccattagacactcccacaaatgtcaatcatactctttgccctaaaagttgcagactacttgtacatgtcctttatcctacatgtgtacaggaaacacgtgcagaataacatgtgtttttgtttcttgaaagaaacaagaacccaccaaaactttatagctccgggacatgatgataattatctcaggtccactcagcctggctccacatggaaaatatgggtattgtaaagaaagcttttgaattttggaggcctaacaaaaagacctaggaagctaatagttggttatgagataattataacaatggtgatgaaagcaattgcgattattacttttatgttagtgagataaatacataagaatgtccttctttaatttcattccttaatttccttaatccccattcttgatttctggattagaggaaagctatactatctacctgattacacaaaaagactggactgaggggtaaccattaggactcttgttagttgaaggtaataaactatattacttcagtggctaaaacaaacaggagcttttttctcatataaaactagaagtcaggaaacaaatggttgctgatgttggtttatccgtttgacaggttctacctttatcctggagattctttggcctttatttctttagtaatatagtagtaacagcactgaatctaaaataagagcacttggtccaagcactggctctgcccccttagtgacagtgggacccatggcaaattatttaatctctccaacagttaattttctcatctgtaaaactgggatcctgataacttccatactagtttggtgttaggattcaatgaaatgacgcatggaaaagtccttttcaaatggctactcactatacaaatattaatgtcttagtaagctcaggctgctataaaataatgccatagactgggtggcttaaacaacaggcagttgtttttcacggttctggaggttgagaagtacaagatcatggtgctgacagatgtggttcctggtgagaaccttcttcttgctgtatcctcgtatgttggggagagaggtggtgcagagaggtactctagtctctcttcttgctcttcttaaaaggacactaatccaattatggaggcctcaacctatgacctcatctaacccttattatttctcaaaggccccacctccaaatatccattgggggttagcacttcaacatacaaattttagccggcgggggggatgccagcattcagtccataacaatcaactatcctcattattgagagttccactaggccttctcaagggttgacaatgatagtgccctgctagctataagagtaaaaaaattttcacatctagaaaatgggtgcacgaatattggtaactgttctaatgtctatgcacagaatttttagaacttgctcgagaaatttgtctttcctgacagtgttgcttctcttaaattccagtcgagggccttgaaaaaaataggttttccatcaagattctctgaatgaataaatgaaatgctctgatattttctttcaatattaagataaagcaaaatgtatacagaattttctattttcagtgtttccaattactgcatggtttggcttattaccatctctaagtctaaccctgggtcataggagtaaagccattgggggtcccctacaaaggatacaaggcagtggtagatacaataagcctgacaattggagtcagatttttctctttcatacaggaaccatggaactgttgccctgggccacagctggctctcagaaaaacgtagaactggtcgaggaaaggaaaggcagggagtccttgattcacttgttatcagaaaattgtctgttcaaacaacagaatgtttgaaaagataaaatcaagtctcaaatgcacagaataagaatgaggggaaaacacctttctctgtaattaaacagaaaagtgtgccatgaagtgataaaacccagtcaacctgaaaatgtgaacatcaagtgtaattgtgcagaacgataaggtaatatgaacagcacaggaatatataggctcacgttggcattttaaagcaatggcactttacctgttcctcatgaaggatttggtttagtctaatcccttgtaggagccactaagaggagaaggcacagtccttttgggatgtaaaatggggaattctttctatgattacaagaatttgtaaattgctcagagttttaggacagcaggttatgtgtctctcaatgttgggtaccatgccaaacgtactttaagagacatagcaataaatagaatgggattcatttttttcttaatgtctggcagggcaaccaaaatgcccacgtttcccttcagtagcttggtattttggtaactaaaaacatgttccagggaactccagaatatgaaacatttcagacaatttgaaactgtcaaaattttcacttctttatgggacaaataaaatctaactttattcagattttaaagtatctcataaaagagtaatactttagatttgtgctgtgctttatacgaattggatgaggaactcttatacatatataagtggattttattttcacaacagtccctatggtagatattgtccttattaagtaaatgagagaaccaactatcaaagatattaatattttgcataagatcacacagatagcggaaccaggatttaatccaactcctctgattctaaaaataggtgttagatgggtattctttccccaaacctatgctgaaaggaggctacatttggagtcagttattgaaagtttaaatatatgtgtatatatatatatatatgtgtgtgtgtgtgtgtgtgtgtgtgtgtgtattcttatatactcatgcatgtagatagttataaagtacatgcttatatgtcaattttatatatacgactgatatataaactatcaatttgtgatagtttatttcaattaagttcaaacatattgggtatttattgactcatgggacttaaaatttctcagaggcattaatttctatgcctttaagcaaaataatgtttagcccgttttagaaagataaaaggctaacatatgttttgtttttgtttgttttgttttgttttgttttgttttgttgagatggagttttgctcttgttgcccaggctggagtgcaatggtgcgatcttggctcacagcaacctccgcctcctgggttcaagcgattctcctgcctcagccatctgagtagctgggattacagacacgtgccaccatgcccggctaattttgtatttttagtagagacagagtttctccatgttggtcaggctggtctcgagctcccaacctcaggtgatccacccgcctcggcctcccaaagtgctgggattacaggcgtgagccacggctcctggccgctaacacatgtttttaaaaaataaacaccattcgagtaggaaaagtgggagaactggtggttcagctagagatacggagatgggagggcaagttgctttctcatgttgccacatctgtaagttacaaatgccatagattaggaatttcaacgttgttgtgtctctctgaggacattctccatgtagtatatgtttcgcctccctgatggacagtaagcatcaaacggttactcctttatatttgaattattttaattctaacatcttgttctgaaaataacgggaatgccataaatacttactgattgattggactgtctcgcaggggagctggcagctagtgtaggctacaagctgccatcatcatctccatgaccatgagtcatcactggaattaccctaaagaggttaataaaacgccttgtttgaaaagcaaacaaaaagccagaagaaacccaaagcaaacagacccagactttgcaatgggtagtgaattttcagtcttaagggattgagagtccttttagtacaatctctcataaacatataacagattttaaaagcaccttggtctgattccagttcacatacctcatccttgcagaatacaacatactaggccatttgaaatgttcctcagtttacttttggaggatctgctgatttgagcaaaatggaaatgaaatgtatatagaaagctcttaatttttttttttttttttttttgagacggagtttcgctctgtcgcccaggctggagtgcagtggcgggatctcggctcactgcaagctccgcctcccgggttcacgccattctcctgcctcagcctcccgtgtagctgggactacaggcgcgcgccaccatgcccggctaatttttgtatttttagtagagacggggtttcaccgtgttagccaggatggtctcgatctcctgacctcgtgatccgcccgtctcggcctcccaaagtgctgggattacaggcgtgagccaccgcgcccggccagctcttaatcttaagaagttcagtttcgcagctccccccccaccaacccccaatcttgaaagcaggaatttggattagggttttttaataaaactttctttttcttattaccatgatgttttttgagagggtacagagaactcattaaaatgttatgttataacttaagacaaaatgggaatgagaatttgcattatataaacaaagtgtatgactaagtaacctgttacatataaagtgtttgactaagtaacctgttgtccctaggagaagtagaataaatatcaacatgtggcaactaacagaatgtgttgtgatcactaaagcagcacattcattgactttacacttcattaagtaggtaacgaattttacaaattttaggacttaaccaggctgtccataatactttgcatcagtaagtaccaaaatctacgatagggcacttcggagttccttaatttaataatattgataatattttgtttacattttgatttaattgtatcatttcattatttttgtgtcctgattctaaatatatacgtcaacaagctatatggccattcaaaacaggtaaactttaaatatgtttttgacatagaaattatgtaacagtcttcatcatgagtataggagtcagatttccaattgaaaatttcatcctctaaaatacttggcatatgtatacagttgtctagttcagacaaaaaagtattgaatataaagttgattttgtaaaaccagaattggcatccttaaggaatacaaataaagggaatcttaagataatataataatgctgatttgaaatgaaaattaataaaattgttattctattttagtatgctaaattggacagatccttatttcattgaaaaattagattcttcagtatatcagtgcactgtgctaataacacaagaagattaaattatgtccatatgtgatttggtagaatttaattataaatataataaatccttcaatatgtacagcagtgaatattccaaatttatctctcatataagttgtgagcaacttaaggataggcaccatcccttaacatacctagattaagaacagtacctagaaaacagtcatcaaatgcttcctaaataaattttcaccttcaagcttatggcagcaaattaaacatagattgacccttttctaatagagacagaatagatgagactgatgacttttttttataaatgtgtaagtctgcaaatatttagtaaggatctaatttacacaaagaaatcaacctagagtgagattattttattcatttcccggaggctgtgactgaattatatttgcaacttgccctaatttttatacttaataatttgcattagtatttaaattatgtgaaggaaaaatataagtttaaaatactgaaaagtatattcacacattcatcaaatgttgattatgtgcttacagtgtgcaaggtattggggctaggaattatgtggtgttccaaggaaaccatgatacagcctctttcattacagtgtttattattaggtagaaaaagtaaaattagtataatattagataggatatatgtgtcataggagtaatataaacaatattttatgaacaatgtatgaaggtataattttgttcatttatccatttatcgctctgtacatccatccgtttattcattgttcattacttcatttaataatactttagtgaccattggaaaagggatttataaaagtgagtaaaatgttaatcattttctaaagaagttgataatctagggaaagacaaatgtgtaccaacaataacttggatataaagcataaattagaggtacaagcaaagaaaaatgaaagtacaaaggagaaaaatatttggctgcatgagagcagggactgtgtcttgtttcatcatagattttccagaacctagatcagtgtttggcacaaagtaggttcagatgagtttgtgttgactgactgtctactgaagtaattgtggaacatatcatagaagaagtagatcagaggctggatcttaaaactgggagaaatacatttcagctccgtgaaaccccagaagtgatatttgacattagaaagcacaaagtcacactctaacagtgacagtactgagtgaagtaagaattttctgcaccccttcttcttcttccactcccattaacccttgttagggtgagaaatagcagctggtgaatggtagagaagactagcaagacagaaagaggaagcccaccatgcccactaccccaggtagtaaaggacctgtccacttccatcctcttctaattgaggaagaaatcatatatgtgagttcagattgaagtattgattaatatattgagctggatattctaattttaatgtctcgatatggagcaggactttgtttccttaatgatgaccagaaaagacatgaaacttacccatattttcacccaagaacagaacagaacaacctacttgaacagatttaaagggagaaccaaaggcagataaagttgtctttattcttacacagcataagtcctgattattcatcaatttatacattttatgaatttaagaaaaaaggaaaggaagactataaagggattcatatcaggatacacatgaaggtaatgtagtcagttttttagtggaaccaaaatattacagtcatcactgaacgaaaatattacaatcattacatcattcactagattaagtgaataaattaaaaatatattaaataaaattaacaaagacatgagcttttcaaagtgtgtggtaacctggagcaataagcagtgtagttggaatgttacctcttaaggattatcaaagaggctggctgttcagtaggacagtggtatggtaaagcaagcttgctacattgcagaactccagagggcaacattctaattatctttagctatggggtctgttcccataggataactataacttagtaggttgacagagcctcccaagaaaccacagcagtgctcaattgtggcgaattacttctctatcccatcaaaatgtcgtgattggacccacaactgtgcatacatttttttggcattttcctgccagaagcatatttacatttctttaatatccagtcatatccttcccttatttaaaaataattattcagagaattccagttttttgtaatcctctcttctatgaattttagcaacacttatatacagatacttgatattctggagaaatatgcttcaagaccatgtggattaacagattttcaaatgccgttatagtatatgtatatactatatatgtataagtatgtgtagtccccaaaatgcgtactttaaaatcctcataatagatctcttacagatgaggaaaagaagatgtagaaaggttacataaagtagctaacaagtattccaaataatattgaacttcagtctgactattccaaaattgcattcttaactctgatttctatatttgttttccattctaaactgtgtattgtgatataagttcctcactaaggctctttttcagggtcttcctaatactaaagtcactcttacaatgagtattttctttacgtgtgaaatccaataggcaaaaaaaaaaacttggcaataaattttaggcattaacctcatgccaagtaattatcagaaggctgtaatgctttgaaacttcacaagtctgattttaagataatggaatgaggcttgcattgtgaactttcttgatgctttacattgcaatatgctgtatagattgacttcctaaaaataaaaaataaaaaaaaagatttgtagagcatactgggaaggtcttgccaattaaaaaccggagattggctgaaggcttgcagcaattgaattttgaatacagatggtgtcaaatcgagtgtttccatagcaacagactcttccttaataacttttagatgggagggggtacataaaagagaaaaccatcttttagcagatgtatgttttcagcatgttttcagattgattttggaagctaatttgtacttaactagtgattgttttaagtggatctaaatattactaaattctcctgaggaaacattttgagaataacagaaataaactctaggaactttataaagacatgaaaagggcacaattttacaaaacctttttttttttggtctggagccaatcaaacagtattttatattgagtatgacctatcaatagtcaaagagttcttgattcttaatgcctgttaatattgaatgtttagaatatgggtaaaatcaaggaaaaagtgctatgtatctcatggatttggaatatcttaatatactctttcttcaggttaatgattatttttaaaaaatgatgatataaatcatttcaggaaggactgcataaagaggtcattgatagagttcatatcatatagcagagttgtcgtagatttaatgtccaatcctcagttttgcatagccaacaactaaattttagtagtttacctagagatgatcaggctctgggagactgattcatgctacacaaactcacaaggcactggtttataaaccatttgaaagaagaaataataattcaaactattattttacaacaagactggcaggaaaatcaataatggtaatgtgttcggggtgtcctccccagtgaggactatccagaagaccaaatgatagattattgttcaaagtgatagaattgggagaagggtaataaagcattatgaaaggatgcttccttaagtgagaaaagctacataaactacccatctttactattctagatgaccttaaaaatattaatagaaacagagaaacagacaattcatctcagatggtacaaaaaacataatagcacatgtttgctccctggcttccttttagattccctgcaagaggttttcccccaaccaccaccatatacagatatacagctttaccttcactctcctattatctgtcacagaacaatataaaactcagatatgttagtataagttaatagttggtagctttatgttaatgacattgctacctgttacccccagattcatctgggttacttcatccccaaaaccctttcaaaacgacatttcccacaaagatttctagtattactggccattcccggacatcttgcttccaacataagaaattctgacataatagggatataagaaggccttgggaatctgtatttataacaagctccccaggctatctgaggctcagccagtttatttttgcagatagctattactatccacaatctcttttatcctattgtaattgcagaagaaaatctttctttctagtttctttgaaatttctggaatgttaggacttagagcctctaggaacttgtacataaaaagagagacttaaagagatatcaaagtagagatagagatagatacagataagtgcatagacatagaagtagacatatataatagaaacatatatgtatacatagaaatagaaatatgccatttagaactcttaagaaatatgtgcactcttaaaatatagtttaaaaatgtaaagaacttgctattaattgaaaatagcataataaacttaaatgaaataaggaccccaaacgcaaatatttctctctgacacaccacacacacacacacacacacacacacacacagacagagagagagagagagagagagagagctgtacaataacaaccaattcctgacccagataaagaaaaaatttttatttatcttctttctcattctattattattttttctagattaaattaaaatggtaattatgtgtaagaacaagcattattgccatataaacaatgcaacaaaggaatcaattgaaaattaagtgaaaataaaaggtacagcttcgttaaagacccagttcttagagcttagtctcaaactctttgtactctgcactcttttcttgatttgactcgattgattgattgattgattgattgagtcagagtctcactctgtcacccaggctagagtgtagtggctcaatctcggctcactgcaacctccacctcctgtttcgagtgattctcctgcctcagcctcctgagtagctgagactacagacatgtaccaccatgcccagctaatttttgtatttttagtagagatgggacttcaccatgttggtcaggctggtcctgaactcctgaattcaagtgatctgtctgccttgttcccccaaagagctgggattacaggtgtgagccaccacgcccagccgattttactctctttagaactgcaaaagtaggaatctagctcatatgcagacattctagaaagtttgatttcaaaagtcttctcaaaagaaagagagcaagagcaagaaagaaagcagagagagaaagcagaagataaaatggcattgtttgaacagggatggaaactgagtaagaaatttggtcactaaacactttagtgtctatcatttaagattgtaatttggttatttatcactggaaagtgattaataatctaaaatgcattttataatactaatactattaaaacattaatttttggagaaagtttattatagattgatttatacttaccactgaatattaaaatgtttaatggaagtagtttcaaatagtatttaatgatatagggaattattacaacattaatgctcaggaaaaaaagtaggatatggaattatttatgccataggatcctaattttgtaaaaaacagagaaaaccagcaaaagaaattataactggaaggaaatacatcaaagtggtttgcagttatcactcatgaaattgaggtgaacttgatttttttccttttatatccatccgtgttttaataccacagacatgctttagatctgcccgtatattgtggctttcagagggtaataaaccattgtgactcagaaatagctaagaatttttatctctcaagaacaaattttcactcccttggggtgtcattatctgttgagaatgcatgcaatagttcaagagccaaaagactctgattcagtaagtttagggtagaaaaaaattaagtacatttttaaaatagagctctggtgtttcaaaggcaatgtgcaaatatacctacttaatattattctaattttttcaggatagctgaaatataaacatctatttttagtaataacacaaatgatggaatgcttttacatatttataaatcattaaggatttgctttttgtttctactgtctggaacatataaatttgaacacaatttagaacaacattcaggaaatatgatttatttattaccttcttgacctttattttatttttaccatctacttttatgtaagtcttttttttcaatcattgtttatttctttacttttccttccacatagaattaaagggagattcgggcttagtgtccttaattcatagttccattgtggctattaaaaggtgaactgaaagcttgcaaacacgtggtaccttgtagataattttctccagtcagacagttagataaaggcctctgaggtttctggggtcattgttgaagctatgttttaaaatcctatatccttctctcattgttggttccttttcacaacacagaagttttcttttttttaatttcaacttttagatacagaaggtgcatgtgcagatttgtcacgtgggagtattgcatgatgctgaggtttggagtacggatcccatcgccatgttagtgagcatagtaactgataggtcgtttttttaacccactcccctccctcctccctctagtagtccccagggtctattgttcccgtatttatgtccatgtgtgctcagtgcttagctcccacttataagtaagtgagaacatgtgatatttggtagaacttttcatttttaagttaaaaaacaaaacaaaatgaggatgagtggaagaactattcagcacagcaggttataaaccaattaggatgatgacgccctgaatggagattttcatgaacatctcatattagctatttcagctttggtttttttaatgttcaaagtaaatagaataatgaagaggctatttaggaaggtttagactgagggaaaaaaatcctttcattaggttccaaataacggttagcttattaaacagcaagaggcagagatttagcagagaaaaaataaaaagatttaaaaaaaaacaacgagattaaaaggtcagtaataccattggaactggcagcatggcaagtttatatcagctatcttttgttttggaacacaactatgctaattctgttctgaacctcttgctaatgcctgtctcaagaaaatttaacatactttatctgtgtgtacaaaaatacctaaggacaaagctattacccaaactgtattcagattgaaagaatccatatagaaatttgcagctaacgtattagtcagtgtatgtaatttctactgcttcacagcacaactctttctaattttcaggagcaatatagcaactgcttgccagccaagagaaaaccataggagcattcttatcattggagccaacattagttctgcctacagtgactaacatagatgcgtttattgctagctggaattttccattggcactagttacatgtaataagttagtgctttcaaatggaccgtggaatataggaaaactagagtctgacgtaaccaaaaaaaaatgttgataaactcagagattatgaaagagaggagaggagtggtttttgtggaaatgatagaaaagcaaaaaaagatggcaggatttggaaaaaagaaaatcaggttagagatttaattagtaaaggagctccttttaataattatataagagtatgagtttagagtaactgcctggctaatatgtacaatcttcaagttcagtcgttttccaaaattctaacttttagcattttttttttgtaaattttaagtggaaatcttccacttttgttgactaacttggctacctgatattttactcaacctcctactttcttgttctctacttcttctgagtctttgcttccacaatgaggtagctcatattccttaagtttcctgtctggttttgcttttttttttttttttaacagctaaaataaactctacaagcatttctatcattttctttacatccaatctcttgtcagccatgtcctaatcactttggtaaagtatcagtgaccacccaagaggttcactttgcttcgtcaaaggaccacctgtcatgctttatctccagagcttctgccttgaaagtaagaataatataacctttcctgaatgtcttatttcaatttcatgcatttgatctgcctcttcagaccattcccaaggctttgcccttgttctttaccctcatggcttcagttattcatcactatatgaatgacagctctcaaactgacagctctggcctctcacctatttcatctattccatatggcaaactgtctatattacatttcatcatgagggataattataattccacattcaacaagaaattgtgggtccgtgttgatttccaacagcaacctttattttttagactatgatagagaaagggtcaactttctctcttacttatttatctcaaataactcaaagtcaagctagaaaagccaagcaagtaatatttcccaacaaagcagctttaagcaaaatgattttcagacacgacatgcagcctgtattgtggaagaagcacagtgacctaggtgtactttgctgaaaagcagtggtcacagtccattagtttcatctttttcctgcaagagagaaaagtatggcagggccaagactcctaagaccccttaaaaaattgtgaggtttttataaccctgttcatttcccatcaaaagcattcatgaagcacctgccatgtaccagatgatgcattctaggcagagggaagaacttgggcaaagtcctgtacattttatcttctaaatcttactaatcttttcttatctttccatctaccacccaccatcaggctgtgcctggactcctatgctaacatcttactctgtttttctgcatcttttttgccctcccctccaatctactctccaattagcaacatgactaatgttttcaagcccagattagacggtgtcacttccctgctttaaacctttcagtggattcccattgcactgaggttgaagaccaaaatctttaccataactcacaaggccactgggagctatgaaaattttcttttttagtttttccttttaattagtgatgcattcaataagtggagtctatcgtgaaagcatagattccaaaggcatgtgaatactcaattatgtaatttacttacagaatgtttattacttcttttttagctttgattttgtatacatcctaactcaatctcagttatataagagattataaaaaagtttgtgatgaatgcatacataaaggaacaaataattaacaaatatataaagacaaatcagtattgaatgaccaaatggctctttatttattaaagaacttagaaaaatatagtcttgcttgagaccaagttctggcaacgtatgtgtgtctttttgtttgggttaaaaagcattagttttatatgttttaaaaggataggatcttcccttggctgcaaatagtataggcaaaatgctattctgtatcttattttaaagaaaataacaatcataccttattatttgctgacagttttgcagtttacaaagcactgttcacatggattaccttattttaaattcctcaattttttttccttttactatgggaattctgtttcaggagaatttccctttaaaattaaggtgattatactattctgttcctgtatttcgtagccatatgtttcaccaaggtattgtctctctccaggtctttcttctctggatgtatagttatgattttccaggaggtaaatgaaaacagtgggagcaattgacagagtgttttttgtttcccataaacccaagcattgcatttaaggagctgctgtactattgtaagagttcctatactaattttaaaagttcatttacatattttgtagatttttaggataagtcatcagaaaaaaattaaaaataaatttacatattttgtattaagctgttttgttacttgaatggggattattggaacgaggaaagaattacttttatctccccatttttcaaatcatttactataacattcatgaattgctgaagtttaaacaatcaaaaatatctgaaaatggagcctaggaagggtaacttatgtctttcatactccttcctttttggtttttctaccagcattttagtctaaaatatattttattttcactgatcctgtgtttgtcttaataatatagtatgtatgttaaatgaaccagaattcattgatctttttttttattattcctctttttgcttttctggagaagcatttgaagaaatcagttcaggctacacttcatcaattcatttcctcatcttccccttaatacaaaagccccattttcactcttcaaaacatttgatcacatacttaattttcatagcattgactaaatgtatgtgtttattttgtttatatattgcatatttgtgatgattttcacttttacagtttaggcatgggtaggaaggacacttacatgagtacttaagttcttggttatgacttgagaaactcacaaggtagcatggaatggcacgtaaacaaggctttgatagggtgaaagggaattatcaggacaaaactgactagtggcagtgacttttgagcagagtgctgcaaactgaaaaggcagagagcattgtaggcagagagaaagcatagacacatgtgagatacatgtgaaatacttagacaaatgtgaggtgtgtggtaacattgtacatacctagggctccttcctgtgtagctgtaaagctggagtataggcatcacaacaggcagcagaagccaagaaactagaaaagtagacaaaggccacgttataaaagatcttgtaggataggtaaagagttttaatactatcctgaaagcagtgtggggtgggaggcatgacattaaggaaatttaataagtgatgaaagaccaagattttcatcttcagaagacttctctggaggtgggtggaccacttgatgtcaggagttcaagaccagcctggtcaacttgatgaaaccccatctctactaaaaatacaaaaaaatagctgggcatggtggtgcatgcctgtaatcccagctactcaggaggctgaggcaggagaatagcttgaacccaagaggcagaggtggcagtgagccaagatggtgccactgcacttcagcctggatgacagagggagactccctattaaaaaaaaaaaaaaaaaagacttctctgactagagttttaaagaaggatggggagtgcaaaaggctaacattaaatcagtggttctcatccctggctgcacgttagaatcactagggggagtttaaaaaaaatgccaatacttggactccaccccaaaccagttaaatcagagccttaatagggcccagacattcgtagtttttaaagcagccctcttgattcaaatgcacagacaaggttgtgttccgctgaactagagagaccatcaggaggcttttaactaaagcaatctagggaagagagagatgaatgatatagaggccagaagagctattaaggagaagtgactcggcatcttcttggttaaagtataaggaagaaagaagaatgaaggataatttgcatgtttctccttcagtgactaagtagaggaacagatgtgtatcagtgattaggggagaggaagaatgaagatgatgtaatccagtttggatatgttggctatttcatagagatttagtaggcgtttggctctatggatacagagttcaagagacaattcttagcttaaaacacagattttactctgattattttagagatagtaaatgaagcaatatacatacatgaactcaccagagagaatatgtaaagtgaaaacaaaaagatcaaagggagacccctagggaatagcaacatttaaggaatgggcctaagagagtgaggagtggccaaataggcagaataaaatccaagaaggaatcttccatattaatcaaaagagaaggtttcaaagagggttcgtcaattggcaggtactgaagggatatctgaaaacataaagactttagactctctaatactgtagcaactttaaggtcactgctatcacctacaaaagtaatttcagtggcaaaagccaaaacgtaatggtttagaagggtatgtgaggtgtggatgtggaaatagtgggtatagactattgcttctcaaaatgtaatcacctgaaaaatcttattttaaaatgcagattttgattcattagctctagagtggagcctgagattctgcatttctaacaagttatcaggtgatgctgatgctgctcatacacaaaccatcctttaagtagcactggtgtaagccactctcccacaaaggaggaagacatagggtttccatcaggggacgcaggtggggtgtaggaccaaaggaaataatactcttttgtcttttgtttggttggttttggttgttttcttcttaaaataaacatggttgtagacggagattgaagacataggaggggtaaaagatggaatcacttctcatagaagatggaagagactggaacattgagtacagcgagggaattaggcatgggtaggagggacacctaaatctgaagagaaggaggtaaggaagaattgaaatacagaaaagttctgtcagtaagcaatgtatggaattgtgctttttagccatagtttctgttcaagaaattgttttccatttatttttatttcttaacttgaatagttggatggtggagtatgcttgtaaaaataagagtgaggccactttgtttttcggggttaatttccgttttctgcactcatcaagtaaaagttgaagtggcaaggtgtagatatgaaattcagtgtgtgctaagggagaaaaaaatgctttttattctacatgattttaaaaatatttatattccaacaaatgcatcaaatttgatgtgcaaatttacagtgatgaatgagttttattgtgtgcattgcatgctggtgacatggtaataaatctgtggtgctagaattataatggtcccctttagcttcgctttaatgaactcttgctgaacacttttgagttgttagtactttatttgctacatttggcacttaattagttaatgactgagatgctggaccgatggatcatctaatgatatgttaggcctattatcacatctagatagtttcttttctgtgacttgtaagtgacctaagatgataaactgaaatatttttgcatagatatacatcaagcttttctcctaacttcaggctttcatcttaagcaatagtttccaacacccccaaaagagaagtcattatgtttttaaaaaaattattcattttaatgtgatcaaataatatcacatttcagcattcacctatttaattaataaaacaacttacatgtttcattatgactggatgttgatattttttcataatctattatcctccaaccagtggtaaaaacccaatcctcctctcacccagctcatctttccgtatgggaagcaatacatacttccctatgttttattaccaaaacaggagaatgagctttctttagaaggttaactcattttctctattagaatattcagcatacttttaaggaggtaatctggtctttgacagtctgttgattagaaaattaagagacctgcctaaattccatttccaactcctctccatacacattgtgactttgagcaaaacgttttgccatttccactcgtataagttctgtttagtatctttaaacttccatatcccacagatggtatttttttcttcattggaaagtggtgttagtgattcagaaaactgcttaaataatacactgctttgtgttttctgtgagagaatttttttttttttttgagacagagtctcactatgttgcctaggctggagtgcagtggcgcaatctcggctcactgcaacctctgccgcccgggttcaagcgattctcctgcctcagcctcccgagtagctgggattacaggtgcctgccactgcgcctggctaatttttgtatttttagtacagacagggtttcaccatcttggccaggttgatcttaagctcctgatctcatgatccgttcacctcggcctcccaaagtgctgggattacaggtgtgagccaccgtgcccagccgagagaacattttatctaacattctattttaaaatttttcaaatacacagaaagctgaaagaattgtacagtgagtgctcatgaacccactctctagattttgttgtatcactttacttctttctctacccgccaacccctattattttctgatgcccttcaaagtaagttggtgacatcggttccctttacccctaagttcttcaacatgcatgtcattaaccagagctcaatatttgttcacatttcttttgtttgtttgtttgtggcaaaatttgtatagactagaatgtgtaaatctcatgtgtattatgaaatgagttttgatgaatgggtatacctgtgtgacacatgcctctcttaagatacaaaaaaatagccttggcccagacaggagggaacattttttaggttggcttgagtttcctttaactgacatgtagcatgactgaatatatgaccataagattgccaagttgaaatttaccaaaggtccatccaggggaacagtatggctattgatacgtcatttgttcatctaggcactgggctgggtgagttcttcacaaaaaccttgtaaggtgagctttcagctctgacagaggcatcaagaaacgtatttcacaaactgttagagctgaaaacatctccagggatcatccaatctatcctcctttgctttatgactcaggatttaagaagccccagaaaagtccaacagtgttaccaaagtacacgattgcctatttacgcccctataattgagagctgtctaggggtcaggtacttttctcagtgccttgtgtacattatttccttttatctttctagattattaattttcttgttattatccccatataatagaggagtaaacagtgtgaaaatagcactaaactgttgatcttttccatgttccaaactaaccttaaatgttaggctaatattataaaattttaaaatttagtcatttgttctgggtctggcttccatgaacttaaccaaaatgcttggctgtttctgcattctagctttttgggatttagagaaaaagcaacttggtcatcatagtggccaggatttatttatgtgccaataactcccctctgtttttagctttttgatctgttacatctcagatactttattctctatttgtaaaacaaccacattcctccttttctatatctaagtgaaaaaaaatgcccgttcatactagctacatggttagcatatatgtttcttcctctttgtgggtttgagttgaaacttcttttgcaaagcttaactatagataggtcttccacagaaccctgtttaaatgccttgtggaagtagaagggacatatcttaatattccttataatctgtgttattatttggactttcctcagttccttatatgtctttgtatgtcaaacattgagttatgcttacattactctaggtatagttgtgtcctagctttgtacaaggttacaataatggtggtttccttgttttcagcttcattcttgatcatgcctaacattttttgatggttttagcctcggagaacagtctactgctatttctccctttttcctgatcccaacaaatagtttagaaatctttgtcttaactgcaattgggatcatttttcctttagagttgcccacagttagtcatgtccgtcactcttcactcactcaaatgacctcaaaagatttacctgcaatttaagcctttcaccttggcattttctacctggaactctggcgtactctgtgggatcagtgagatccatagtgtgcactccctagcagatcgtgaatgtttgttgataactataattcattgtttagtcttgtctatacagagaagcagtagcaccttgctttagtaggatcctttatgcttttattcattattgaattttatcttcacaataattctgtggttctgcagttgtcattatttcagtttgggagttgaggaaactgagatcgtggcaaatcaacttttcccatttaaatccactatttcatcgctaatccagggttataacccaagactaactgctagtcaaagttgctttctaaaaatcagttacacagacttctaattctcgtgctgtacagtcagtgcagaaattgcaacagaactgttctttgttctgtagcaatgtgtattcaaaaggtaatcatttcttgtgtataaataacattcctccctaagagagatgttgtgggaatttatatcagtcaagaatgtatatcgataattaaacatagctagtctaaaaaacttgaagtgaaagattggttcgtattcaatcaactgaactgtttctttctctgcaatattgtggttcttgacatgattgctgagtttccaatttgacacttctggaggttcgtaaatcaggacacatgctgggtctcagtctgtcatcctgagtcttagcattggttatttatttccctttattacccaacatctatttactgcacaaattagtcgagaagctttccatgacggacctttgtgagaaaaaaaaaatgtgtacattgggtagctcttcaattacaaacatgcacagattgtctgggtttatgtgcatatactttattattatttcacttttgtatgtcagatgaatttggtgtaaatgtaaatctaacaatatgggctctagtggccaaatacattgccataatatgtttttgatctgtcagtctcctgggtgaagtgtcgcaagtgtggtaaaattctgtagtataaattgatgctcagttatggacaattaccaggtctatatgatgtcagactaccacactgatccacttttaggataacagcttcgctctgatgatcttcagattttagatttgctttcattccttgacaaaatgaaatacatttaaaacttctaaaattgtcttttgtatatatttctgcagggtctactcttgggactactataacaatcaattgtactgctttgtttcttttattaaatagcagaatagctgcttgattcgtctgtatgtgctgatgtgtgtctgtgaatctagtccagttcactgtccaataagaatttctgaaatgttctttgtcacatcaatgtacagtcaaaatcgtattgtgtttgtagcagaatgattgcatcttttattattcacagcagccaaaatgacacatatttcacacgtgacaccttttttaaaaaagatgaattgtccaaagttgtatgtagaatatatttcacaaatcaaattccctatttaataaatggtgctgggagaactggctagccatatgcagaagagtgaatttctataaatagaatgcaactgtgtaaatagcatccaaatcaagaaacataatataatatagccagaagctcaggatcccccttcatgtcttctccagtcatgaacatttcacaagggtgactactatccttacttcaaaagttttctattactttttcctgtttttgtgtattatatgaaggaatcgaacagtcatatctacttgtctgtggctgtatttttccccccaacaatatgtttgtgagattcatccatattattgtatgtagttgtggattgttcacttttcttactgaataatattctattgataccacagtgtatttacacatgttgatatagatgagaaattgagtagtttccaacatgaggaaattgctgtcaacaattctgcaatccatagccatgctatcaacagtctagtacatggtttttggtgaatatattaataactatgcatttctgttggatatacacctgggagtggaattacaactcaaataatattcattttaaaaattttatttcgtttttagtcgacaactatattatggggtacattgtgatgtttcaatccatatatatacattgtggaataatcaaatcaggctaatagcatatctatcacctcaaatacttctcatttttgtggtgagaatatttaaaatcctcctttttagctatttggaaatatacaatatgacaatattagctatagttcctgtgctgtgcaaaagaacaccagaacttattcctcctgtctaactggaactttgtacccattgataaacgtctctcatttttccatccacccaccactgcagcttttgatcaccaccataatactctccatttctatgagttcaactttttttaaactgcacatacaaatgagattatatgatatgtgtctctctgtgccaagtttatttcacttaacctaatgtcctccaggctcatccttattattccaaatgacagaatttcctaggtttttaaaattttttttttatttttaattttttggggtacatagtaggtatatatatttacggggtacatgaggtgttttgatataggcatgtaatgtgaaacaagcacatcatggagaatgaggcatccatcctgtcaagcatttatcctttgtgctacaaacaatgtaattgtacttttagttattttttaatgtacaattaaattattattgactatagtccccctgttgcactatcaaatactaggtcttactcattctttctaactattttttgtagccgctaacaatccccacctatcccctacctccacactaccctttgtagcctctggtaaccatccttttattctgtctccatgagttcaatagttttaatttttagatcccacaaataagtgagaacatgcagtgattttcgttctgtgactggcttatttcatttaatgtaatgacctccagttccatccaagatgttgcaaatgacaggatataattcttttttattgctaaatagtaccgcatcatttatatgagccacattttctgtatccattcgcatgttgatggacagttagcttgcttccaaatcttgcctgttgtgaacagtgctacaacaatgtgagagtgcagatagctcttcaatacactccctccttttcttttgagtatgtacccagaagtgggatttctggaacatatggtcattctctttttattattttgagaaacattcatactgtctttatggaggccgttactaattcacaatactaccaatagtggataaggtttccttattctctgtatcctcatgaacacttgttatctttcaactttttgataatagccaatccaaaagatatgaggtgatatctcattgtgattttaatttgcattttttgatgattagagatgttgagtattatacatatatgtgtgtgtatatatatatatatatatatatatatatatatgctgtttgtcatcttttgagaatgtctattcatatatttgcccatttttttattagggttatttgttttcttgttattgagtagcttgagttccttgtatattttggatattagcaccttatctaatgtatgatttgcaaatatcttctcccaatctgtgggttgtctctttattccattaattgtttcctttgctgtgcaaagctttttagtttgatgcaatcttacttacctatttttgtgttgattgtgtttgggggtcatatgcaagaaaccactgcccagaccaatgtcatggagctcttctcttatgtttttgtagtttttagtttcaggtattacatttaaggctttaatccattttgagttgattcttgtataaggggtgagataagggtccagttttattctgtatgtgaacattcagttttcccaataccatttattgaagagactgtcctctccctattgtgtgttcttgctacctttgtcaaaaatcaattgatcaaaggtgtgtaggtttattttagtcctctttgtcttattccattggtctgtttttatgtacttgccatgctgttttgattattatagctttgtaatacattttgaaatccagtagtgacatacttccaattttattctttttagtaaagacagctttggctatccagggtcttttgtggttccatgcaaattttaggattttttaaaaaaaattctataaagaacaatatgcagattttgttagtattgtgtcgaatctttagattgctttatgtttaacaatattaatttttccaatttatgaacacagaaatctttccatttatttgtgtcatcttcaatttctttcgtcagtgtcttatagtttcaacacgcagatctttcactttcttggttaaattcactccaaatattttttcatgctattataagtgagattgtttccttaatttctattttagacagtttgttgttattgtacaaacaataacaattgttatcgctactgatttttgtaagttgattttgtaccctgcaactttactaaacttgtgtatgaattctaacagttttcagtggagtccttaggatttgctgtataagattatgtcatcagcaagaaggggcaattttacttcatccttttcagtttggttgccttttatttctttctcctgcctaattgctctggctaggactcccagtactaagttaaacaagggtggggagagtgggcatctttgtcttgctcctgatcttagagaaaagccttctacgttttactgttgtgcatgatgttagctgtgggcttgtaatttatggcttttattcttttggagaacatttcttctatacctaatttgctaagagtttttctcataaaaggatgttgaattttgtcaaatgctctttctgagtttattaaaatgatcatacggtttttgtacttcattctgttatatgttgaatcacatttattaatttgcatatattgaaacaaccttctatcccagggataaatccctcttggtcatggtgaataatccttctaataaactattaaatatggttcactagtatttcattgagaatttttgcatctaatttcattcgtgatattggcctatagttttctttccttgtagtgtctttgcctggctttgggatcagggtattgctggccttgtaaaataaatttggacgaatcccttcctctttagttttccaaaagagtttgagaaagatttgtgttaggtcttctttaaatgtttgtagaattctcccatgaagccatctggtcttgagctttcctttgatgtgagaacttttaaatactgatgcaatctccttaactctttccttagctgttactggtcttttcagatttccaattttcattattcagttttggtagattatgtatttctaagaattcatccatttctgttaggatgtccaatttcttggtatataattgttcatcgtagtctcttaggatcctttgtatttctgtgttatcagtcataatgtcttctctttgatttctgatttgatttatttgagcctgctctcttcattcttagtctagctaaggatttgtcaattgtgtttagcttttcaaaaaaccaacttttagttttattgactttttttctattgtttctctagtctctatttcatttatttctgctctgatctttgttattttcttctttctgctaactttgggcttaattcattcttctttttgtagtttcctgaggtataatgttaggtatttcatttgagatatttcttcttttttgatgtaggaatttattgatataaacttccctcttagcactgcttttgctacccccagaagtttttctatgttgtgttttcatttctgtttgtctcaagacttttaaaaaatttcctcttgaatttcttcttttgacccaataattgtttaggagcatattgtttagtttccacatatttcttaattttatatgatttctcatgtaattgatttctaattttatattgtggtcagaaaagatacacgatgggttttcttaaatttgttgagacttgtctgtggcctaacatatgatctatcctggagaatgttacatgtgtacttgagaagaatctgtattttcctactgttcagggcacaatgttctgtatatgtctgttaggtccatttggtctaaaatgtcattcaagtccaatgttttcttatgaatttttctgtctattgcttaaagtggaatattgaaattgcctgctattattatgttataggctatgtttcccttcagatcccttaatgtttgctttatatatttaggtgctctgatttgggatgcttatatacttgttatgtcctcttgatgaaataacctttatcaatatataatgatgttctttgtcactttgaacagatttgacctaaagattattttgtctgaagtaagtgtaactaccctgctctctttttgttctcatgtacatggagtatcttttttcatccctttactttcagtctatgcatgtcctttaaggtgaaatgagccacttgtaggcagcacatatttgggtcttgttttttgttgttgtcgttaatccactcaaccactctatgccttttgattggagagtttaatctatttacattcaaaataatgatggatgggtaaggacttactagtgtcattttgttcattgtttcctggttgtcttacagattctttgttcctttcttcctctattgctgtcttcctttgtgttttgatggttttgtgtagtagtatactttgggtcttttgtttttatcattcatgtatgtattataagtttgtgctttgtggatactccgaggcttacataaaacattttataagctgataataacttaaatttgattgtgtgcatatactcaacactttgactctccctcctcccacattttatgtttctaacatcacaacttacttttttttttaattatactttaagttctagggtacatgtgcacaacttgcaggtttgttacatatctatacatgtgccgtgttggtatgctccacccattaacttgtcatttacattaggtatatctcccaatgctatccctcccccgtcccctcaccccacgacaggccccggtgtgtgatgttccccttcctgcgtccaggtgttctcattgttcaattcccacctatgagtgagaacatgcggtgtttggttttctgtccttgtgatagtttgctgagaaagatgatttccagcttcatccatgtccctacaaaggatgtgaactcatccttttttatggttgcatagtattccatggtgtatatgtgccacattttcttaatccagtctatcattgatggacatttggattggttccaggtctttgctattgtgaatagtgcagcaataaacatacctgtgcatgtatctttacagcagcaggatttataatcctttgggtatatacccagtaatgggatagctgggtcaaatggtatttctagttctagatccctgaggaatcgccacactgacttccacaatggttgaactagtttacagtctcactaacagtgtaaagtgttcctatttctccacatcctctccagcacctgttgtttcctgactttttaatgattgccattctaactggtgtgagatggtatctcattgtggttttgatttgcgtttctctgatggccagtgatgatgagcattttttcatgtgtcttttggctgcataaatgtcttcttttgagaagtgtctgttcatatccttcgcccactttttgatggggttgtttgttttttcttgtaagtttgtttgagttctttgtagattctggatattagccctttgtcagatgagtagattgcaaaaattttctcccattctgtaggctgcctgttcactctgatggtagtttcttttgctgtgcagaagctctttagtttcattagatcccatttgtccgttttggcttttgttgccattgcttttggtgttttagacatgaagtccttgcccatgcctacgtcctgaatggtattgcctaggttttcttctagggtttttatggttttaggtctaacattaagtcttcaatccatcttgaattaatttttgtatatggtataaggaagggatccagtttcagctctctacatatggctagccagttttcccagcaccatttattaaatagggaatcctttccccatttcttgtttttgtcaggtttgtcaaagatcagatggttgtagatgtgtggtattatttctgagagctctgttctgttccattggtgtatatctctgttttggtaccagtaccatgctgttttggttaccgtagccttgtagtatagtttgaagtcaggtagcgtgatgcctccagctttgttcttttggctcaggattgtcttggcaatgtgggctcttttttggttccatatgaactttaaagtagttttttccaattctgtgaagaaagtcattggtagcttgatggggatggcattgaatctataaatttccttgggcagtatggccattttcacgatattgattcttcctatccatgagcatggaatgttcttccatttgtttgtgtcctcttttatttccttgagcagtggtttgtagttctccttgaagaggtccttcacatcccttgtaagttgtatttgtaggtattttattctctttgaagcaattgtgaatgagagttcactcatgatttggctctctgtttgtctgttattggtgtataagaatgcttgtgatttttgcacattgattttatatcctgagactttgctgaagttgcttatcagcttaaggagattttgggctgagacgatggggttttctaaatatacaatcatgtcgtctgcaaacagggacaatttgacttcctcttttcctaattgaataccctttatttctttttcctgcctgatcgccctggccagaacttccaacactatgttgaataggagtggtgagagagggcatccctgtcttgtgccagttttcaaagggaatgcttccagttttgcccattcagtatgatattggctgtgggtttgtcataaatagctcttactattttgagatacgtcccatcaatacctaatttatcgagagtttttagcatgaagggctgttgaatttggtcaagggccttttctgcatctattgagataaccatgtggtttttgtcgttggttctgtttatatgctggattacatttattgatttgcgtatgttgaaccagccttgcatcccagggatgaagcccacttgatcatggtggataagctttttgatgtgctgctggattcggtttgccagtattttattgaggatttttgcatcgatgttcatcagggatatttgtctaaaattctctttttttgttgtgtctctgccaggctttggtatcaggatgatgctggcctcataaaatgagttagggaggattccctctttttctattgattggaatagttttagaaggaatgataccagttcctctttgcacctctggtagaattcggctgtgaatccgtctggtcctggactttttttggtttgtaggctattaattattgcctcaatttcagagcctgttattggtctattcagggattcaacttcttcctggtttagtcttgggaaggtgtatgtgtgcaggaatttatccatttcttctagattttctagtttatttgcgtagaggtgtttatagtattctctgatggtagtttgtatttctgtggtgtcggtggtgatatcccctttatcattttttattgcatctatttgattcttctctcttttcttctttattagtcttactagcggtctatcaattctgttgatcttttcaaaaaactggctcctggattcattgatttttttgaagggttttttgtgtctggatcttgtaggtatgcttcattgtttcttattatttttttcttttgtcttctctggctgtgtattttcaaataggctgtctgcctacaagatccagaaaatagcctcaaaagggtcaatctaagagttattggccttaaacaggaggtagagaaagagatagggatagaaagttgatacaaagggacaatatcagagaacttcagaaacagagaaagataccaacattcaagtacgacaaagttatagaacaccaagcagaattatctcagagactacctcaaggcatgcaataatcaaactcccacaggtcaaggataaagaaagaatcctaaaagcagcaagagaaaggaaacaaataacatgcagtggagcttcaatacatctggcagcagatttttcggtggaaatcttaggccccgggcatatccagagatgctgtctgagggccagtcattggagtcaaaaaccttagcagtttacctcatgttctattctattgtggctaagctagcactcacaccacaatataaagtgctccctgctcttccttgcccttttaaaaggcagaggatcctctccctgtggccctcaccaccatgagggttctgcttggcctccactggtgttcacttaaagcccaagggctcttccatcagcttgtggtgaatgctgagagaactgggacccatattttagggccttgggctcccctctggcccaaggcaggaccaaaaatgctgtccaagaacctaggccaggactcagaaatcccagaagcctgcctgcttctctgcctttctgtggctgagctggtacctaaggggcaagacaaagtcccctttacttttctgtctacttttctcaaacagaaggggtctttcaccataaccaccacagctgggaatttgctgggtgacctatgaagccagcacatctcagaggccaagtcccacagtgtactccctgggtattgcaactggttattcaacgttcaaggcctctttagttagtagctgatgaatcctgataggactgagtccttccctttaaggtagcagattcccttttggcccagggtgtgtctagaaatgctatccaggaactagggcctggaatgggggcctcatgactctgcccatgccccatcctactgtggctgagctggtatccaagatgcaagacaaagtcttctttacttttcgctctcttctccttaacgagaagtaaggagtcacttctgttgctgcaagcttcactgctgggagtaggggaggtatggtgcaaccactcccttagccatgccagctggtgtctccctaggtcatgtgggagaccctaatccactggcttcaatatatagagggacgtttctaaattatttatctgtaatttgattaagaagatagacacaggcaataggatatgccaacagattctctctaacctatagttattttaagaaagttagggaaagagaggtcattgattagttttggcttactgaattatttgaccctcccatatcttttaatttatggattttatataaggcacagatattctactagtaaacatgacattaaagatgttttatacaaatgaatgtggttgatacaaaggcattaaataagaaacaaaggaaattcagaggacatttgttcgcctggaatagagatcattagcataagcataagaggaaaataaggaaggaaatgggaaagtcttgagtccattttcaaattatgaaaacttgaaatgcaacaaacaaatagtggttacttaagaagaaagactgaagatgctgggcaaaggttaactttagaaatggcatttttatatcattataaagagaaagtggggataatggaaataatctacatgtacaactcatttgacagacatttattgaaggtattccaaatgccaaacactagtttgtgcactaaggatgtttttaatttttactttttactttatttttattttctagcttcttccgctttgccagagaaggatttttttaaatggataaaatactaacttaggctagcttctttcagaaacagacctttaaacaatgattaatggtgaaagtggtttggttgtaatgtgatcccaggaagtaccagtaggagagtgggacaatgagataataaatgaaagaagccaataattaagccagttatggaactagttattgctttgggccactggggtttgatcctgatgaaggagctctgggagatagtaaacaaacaaacaaacaaaaaacatgcctcaaagttgtcaaccacaagggggtaaaggcaaggaaccagggctaactattccaactcttatccatcattggctaaatgcttcctggtacataaactttccagcacttctggccagcgcacctagcaagctgaggaaaatctctcaggtttgcagtagggcaaatgcttgtactaggacactgctggcatatacttgaaggatgagtgccaacggcagatagatgggccctgacagcatcttctacagattctgtccttgcctttgaggcaaggacactgtctagagtcagagacagaaatgtaaaatgtaaaaatgtaaatcatagtagcacacagtacaagttttaaaatcttaacaaagtgttatgggagaaccacggtgagagaaaatgactgcacatatgagagcaggggaagtctttatatgtgatgatgacatttgagtgggtgttccgttatcaaagatctacttaaaagggaaaaagagtagaattattttaaaccatggatgtaaccaggcgtggccaccctatatgtgaatgtcctgggataattttgtccccagatgtctctctttttgagtgtcattttcatttatgtattcataatataaagaaattgaatagaaagaggtaaacattggtggcaaaaatcccttcctacccataaggctcacagaataatgttgtctaaatgccataacatttttggtaagttttggttctatgggctttggaaattttttatgtaggaactcctccaaggtgatataagcattcagtgtatttatctagataccctagttaaagctactttaagcaggatcaaagtcctcttttaaacttttgtatttgaaagctattcccatgtacaattcccatgattcttgtacaattcctaggagacctttgtttacatcaaaagagtttgtctctctctataagttagaacttgtacattgtagtaatggaaaatccatttcaaagtagcttagacttactcagacaaaatgtattgatcagtgtcattaaacagttgaaagatagacgaggcttgattcaggaattaaatagcatgaccagattctagttttccttctccattgcatggctctgctccccagtatttgttccgtttaattcctcttaattgttctaagatggatatcaggatactgcagaactacgtgctttctcatccatcttaaacaagaagcaatgggttttctcttttagaatcacgaacaacaacaacaacaacaaaaatcctagagttgtttcattggttctgattgaccttacttggaaccataagtccatctttgaattaaccactaaagccagggagatgagttaaaactaagtacacaccatccacagagcaaagagaggtctattgtgggaaaactgcacaaatggaaaaataacaggggaaacacaggagaaggaggtagttagttaatgttcaatacacgcaccttctcagggacttttcttccatctggcatcatctttgtcttttgaccattttccccaatcaatacctatattcatactcaagttttccatatttgggaaaaaacttctcttgacaccaaactcccctctgacttccttcttataatgatctatggttggatagtctacaatttactgtccttactttttcataggtattttttaatctcctacagtaagatttctaccactgcactgaaatcattttgtgtatggtcttcagggaattccatgtggccaaagccaatggatacttttggcatgggctttggaggtctaacttcttgaatccaagtgtcggctctaacaatcactatctatgtgaccttagaccagttatttaacgctgtctttatttcctcatttgttaaatgaggataattgcagcaatagaaaaagaacgtaaacaattatacttataggattgtatgatgattaagtgattaatgcaaggaaagaacaacacagagcttcagacagtgtagatattcaaataaatgttagttatgatttttattatgtcttgtgacatctatgagatttgaaagtgttaatcactcttgtgtttttgaaaatctttcttttccatgttctataaaagtacactttcttgatattcctcctccttctctagtctttcattcatcttatttgctctttgtgttttatttattctttttacgttgtattttccaggagtccattcccagcccggtgttgggctcagtctatgtgccatataaatgagaatgcacttgcatttgaggctttgctttttatttctctgtagtgacggccaatcccagatttctgtctctcccaaaatacacagctatgctatagatccttcagtcctcctgactaaaatgttagttttatgtgtgtgttcctcacaacctcccagtgaataggtccaaaactgaactcattatcttctccatgctcactctgcattctttggataggcagtgaatagcaccactatctaacaggcacctaaaccagaagccaggtaatctgtcttaaacccttttgttttccaagttcttatcataatggctggtgtctaacagatggtaaataaaatagagactagctggctacatggatggatgtgtggggatgcacagagggatagatggattattgagtgagtctctagcctataaatatttttaattaactaataaattatgataatgtacagttgaaggtcaagggtgaaaaagcataccctcagtgggatgcacaccccaaggagccattttaacttgctacataacacacatatgaccacttttttgctgaaagccttctattattgagcaagcattcaaatcccatgtttgcctgaaataatggttcaggttataaaagtttccttctttttccaggattaaaattatcttcctacataataggaagaactgctttatcttttcctaatatctagagatggccttttaaaaatatagactgttttccctattgaaatgaactgtaggatgtacaaaatatttactggcatgaatcaaaagagcttgctatgtttatgtgaaaaccactaggcattctaaaaaatattgctagcatagtaaaatgttagtaattaagactaacgaaagcgaaggcaaattggaatcagagactatttttaaggaatgtcaactgtattattttcaaatacacatggtacataacagtaggatatgagaaaaagtcccaagtatgtgtactaaagtagcctgctatgataagttgaaaaagggtttgtaattggaatatccacagaatatttcagaacacttaaagacattttcatttacactttatacagctttcttataagagcatttacaccatttattttataaaccaaagattaattagaagactaaacaattacaaggcctcaactacgaaagctgttccactacctagtggaacaacaacaatgagacacacaaaacaatggcgttcaaagattagagagagacttacggttaaacagaggttgacatgttaactgaagttgcaatataatatgtcgactagttttgcaatacatagcaaacacccaaacagaaataaacctgataaaaaaacagtagtctataatgtgtgccacttactgagttttaattattctggggactatatttttgatttcatgttacaatcactagttttgtggggtctttctagtcctgatgcttatttacaaaatatctgaagtatttctttctatgtatttatttttgagatggagttttgctctgtcacccaggctggagtgcagcggcatgatctcggctcactgcaacctctgcctcccgggttcaagtgattctcctgcctcagcctcctgagtagctgggattacaggcgtgtgctaatttttgtatttttagtagagactgggtttcagcatgtcggtcaggctggtctcgaactcctgacctcatgatccacccgctttggcctcccagagacctgggattacaggcgtgagccaccgcacctggccatctcaagtatttctttaacttataacttcacataactttgtggaggcaacagggttaattaaaaaggactttacttacataacaaaataagaagcatagttttatattcctgtgccatatacattttgtttgtccatctgtagccattctttgaccttctctcccttgctctttattctgggaggctgacctctgtcatcattgggctcccatgccctttggcttccagttggtttaggcacccaagagccctagaaggaaattgaagacaggaggtaaagtgaggtcaagatatttattctcctaattccctccctttgaggttgccacaggctgactatgtcctttgacaaaaggttattgctcttctcagggtggtttctcattccaattctctgcttttggccacttttccctcccctcatcccttgggcctagatgtagtaacagctctactgttgcaaggttcttgtattatctgtgatggtttcttataccctgcttatcttgtgatttgttgctttgtagataaacctctcagattatctaggcaagatcatagaagaacacgtatgtccagctaagatattccagaagacagtagggaaacattgaagggttttataagagggagtgcagtgatcagatttatgttagttttaatctttaattggggtagaatttacattctaaaacagagatttgggtctgggaggatgatatagagcctcttatggatgtgagggcaaaaaatgatagaggtttgcagtgccaatagaaagaggaaagaagttatatatgagagaaatttgtaactaattatatgaggtgttgggtgacgcttaggaaagaatctagaatgtctatcaggtttcatgcttaagggataaagtagatggcagttttattacttgttttctgtattatttttatttcataaaaccagcttagagaagttgcatagaaaaaataatgtagtcctgtttattttaatatttgaaaagaacatatttcagagtagaatctatatagtacctccctcttggacttccaatgataccagtgatagcctcaatataagccagtcttacaaaatgcacccagcgtgaattcttaggtattgttaaaagaagttggccaggcgcggtggctcacgcctgtaatcccagcactttgggaggccgaggcaggtggatcacctgaggtcaggagtttgagaccagcccggccaacatggtgaaaccctgtctctattaaaaatacaaaaaaaaaaaattagctgggcatgatggcacgtgcctgtagttcctgctactcgggaggctgagacaggaggatagcttgaacccgggaggcggaggttgcagtgagcggagattgcaccattgcactccagcctgggttacaagagcaaaactccatcaaaaaaaaaaaagaaagaaaaagaagaagtttctaatacacttatcttcccttgggttcactcagaagacccttggaaaaggttttaagagcaagtgatttatttggggggtaaattaatcagtagaagagtggaaaaatgagacaggtgaggcaaggcagccagtaaagagtggtgcattatcaagccagctgctgttgtgggtcactggagctttatcccttgggaaactctggaacccttgtaaaatacatgcctcagagttatttcccctagcatcaagggagctagtgtaacaatatcccaattcctacaattagtcattatatacaggctgcctctgggagctggaggggaggcatcagttgcctggtatgtctagcctgtcacatggatggcaaagcaaactcctgtggcaacagaaagccttcaggcaatgaaatgctggcactgggaaatcaggctgatgggtgctgaagtggcaaggatgaggggatatggatattctgctgtagtgcttttctaacagatgattcatatttggttctagggatcaagaattgagttaaaattttatatatatgttgatgttctatgtcaccttcaggaaaataatttaacagaaactaatatttgccatcaaaaaagcaaagaatcctgttgttcatcatcctagccataacacaatgaataattttttaaataagcaacataaatgtgagataacgtttggaagttacatttaaaatgtctcctccagactagcatttactactatatatttatttttccttttattctagttgaaagaattcagaatcagtgggatgaagtacaagaacaccttcagaaccggaggcaacagttgaatgaaatgttaaaggattcaacacaatggctggaagctaaggaagaagctgagcaggtcttaggacaggccagagccaagcttgagtcatggaaggagggtccctatacagtagatgcaatccaaaagaaaatcacagaaaccaaggttagtatcaaagatacctttttaaaataaaatactggttacatttgataaaattataccatagattgtaatttaatgatgtttaatgtaaagttattaacagaaaatcacgttaaagctgaaatgaacagtagactttgtatatttattttcttagagacagagtctcactgtcacccaggctaaagtgcagtggcacaatcatagctcactgagccttgaactctggggctcaagcagtcctcctgcctcagcctccctagtagctgggactactagccaggcgtgtaccaccacgcctggctaattttttaaaaatttttgttttctgtagagatgggttcttgaactcttggcctcaagcaattctccttccttggcctcccaaagcactaggattacaggcatgagttagcatgcctagccagtagacttttgagtcaaggtagagaatagaggaaaattgacagctaatgtcaatgttaaagttaattttgtttagtaatctggatatagttggctggttttctgttgcaccatctttaagatcacttcaaaattggtatacgtatttatgtagttgcatgaagtcaaccattcgggcttaattccttcctagaaaaagtaacaggtctactctttcatatcttatttggaggccctggatcaagaaatgggggtgagtgggtatcaggattggggaggaataaggagtactctcactttctccccccattctcttacctccagcccagctcattcttctcttctttctctttcctctgaaatttcctcaaatatctgtctgcttagtagtctataattcctcaggataaaagaaaaaggaaaaggaagaaaattgcttaataactatgttttatcaagcagcatgcatagtgctttgcatgcgtttaatcccttcaaacttagtatttactagtcagtttgaaaagcccttaaatgttaaacaatggttaagctttagggtattttgagcagggaagtaacatggtaggaggttgatcagattgggcacttgatcaaaaccctctatagatattttatctgacagaaaaggccttttgctaaaccagtatctgattctcaaattggttatgtcatctaagaaggaaaccgtatcattttcttggatgaaatggcttccatttccaaattagtcaggttaggctatgctaagctatagtaagaaatgaactctgaaatctcaatagcttaacacaataaagactgctttcttggttatatcatagtccagtagaggttgacaagccattcttaggagctgtcccccaacatggtcacttggaaacccagacttttccaattttgtgacacttgtcattttcaacacactgccaaaagccactgcagaaaaggaagacagaatgtggtcagtcaatccatggtgttttatggccaggcctggaaattatgtatatcacttccaccacatcccatcacacagaacttgttctcgattgaatttcaggaagagttaatggaattagtgagcttttagccaatctctgtcatagccattttatcgaagggacctgagctgctatgaggacaaggttttagtttatatgatgaggatgttagaaagccacatagaattttacagtcttatcattagctctgttggagtcaaaatctaggtgaataaaaattctttcaagagacacatgttaccactaatggttttttcaatggatgagcatagatgaattaggaatctccaatggtcattttcctaattcctggtctgactatgtaatatatagaatcatgtggttattcttgaaagctctagtcatattcgtgaggtagtcagcatgttatgctacttctttttcttctctataagtttcggatactatgaatctattggatcacaaaccaaagtagttaactggtaagaaggtataagcagaaaatacgaagtttggactggatccttgagttagatgagaagaaggagagatgagaggcatacagtgatagatttgactagggcaagaggactctggtagttagcaaatgagaaataaatttaacctaagaaaatcctaaagtgatggtaagaatggttagggtttaattgctcttagaagagcaagtagctttaaataagagacaaaaatatctgcagaaggaaatatgaaagtagaaaacaaaacaattgcattgtcaaaacatgtaagatgttttaatcacctaaaataaaaccagaattgtattataattgctatcctttgtcaaacttttgaaattaaaaaaaaaaaacgctttggaatggtctaaaactacatcataaaaatggctcagccactatctatagagattgacattttttgtttgtgctctgtgtttaggaatttaatgatgtgtattgctgcagattcaatgtaagttcccgatacagataaagatggccaaagctgtaattttttcatccatttcttgaatgatgtatgctaaaattaaagtaatcctaatgttaataataacttttagtgaatgcttgctgtgtgtcaaaaagtatgctagtcactttatatatattggtttatttcatcctttcaaaaacactctttgaaaagtactcttattattcttagtttgcagagaagaaaactgaaggctagagaagttcagaatcttcttttgaaagtagtagagttgtgatgcgaatgcatagcaattactcttgtagatgacctcacaggcttcctcttccaattgtctacgtggctaaaacaaagcaagaaaaccccataagaatctgaaaaagactcatgtaattattaattgacaaataagattatattacattactgataaaccaacaggtagaaaatgaaagcaatgaaatagtatactgcgaaaaaaaatttcatattatattctttgatgaaaaaataaaacaataattgcaaactgcatttcatttttaatgaaacgacaatgtttaattcttctaaaaggtagggagcaaataaaatggttatctggtctttacatcgaatgtgtcatcactactaagtgatattagctggcttattacttaaaattttcttttaggaaaaaagtgtgaaaatagacaggaggagacattaaatggctaaagcaacacccccttgctccgtaagttctttctgagtctgtgtgcctaagattaacaagagagcctgtgagcctcacaaggcaatcacaaagctatgtctacagccttggagagctgtgattacagcagccagcctcctttgcagcacctcagtgatgactacactaactctcactactgagcaacaatgaaatgtttcaaacccaaccaccaacactgttataactcttaaaatttgagccagtcaccatacctgaacgtaaaaagaaaattaccaaaaatgcttgataccaaaaagcaattaatgattcataattgctaatctttattgacagtctcttctagttcttatctacatatattttaattgtctacataatgtaaattaaattttaaattctgatttgtaaacttaatattgcataaatatttatcaatgttgttaaacatcttttaataattattttaacttctttatattatttcattaatttccatctttatgtccttgctggtctgacatttagaaaaaactcctccttttatttagaaaaaaagaatggtgaggccgggcgcggtggctcatacctgtaatcccagcactttgggaggccgaggcaggcagatcacgagatcaggagtttgagaccggcctgaccaacatggtgaaaccctgtctctactaaaaatacaaaaactagcctggcgtggtgctgcatgcctgtagtcccagctacttgggaggctgaggcaggggaatcgcttgaacccgggaggcggaggttgcagtgagccaagatcacgccactgcactccagcctgggtgacagagcaagactctgtctcaaaaatacataaataaggagaataaatggggacaataacaacctattcacagaacagaaataaaaccggagatgtcatgtggaaaaagcttatcttgaaagcgtggtcagagtggaaagaaacagcaacaggagagtcttgatttggtgaaaaaacagaatgcagatggcatagagtatcaacaattaattagcaggccatcaagagacggccataacatattggtaattgttttctttcacccttaattttttctaaaacaaaaacatgaagttagaaagtagttaattttgttagccacatggcttcatggtttaattttatcttctctatgggcctggtacaacaataaagttcttttgagatagaaagacagatgttaggcaaaaacatacaagattttcattctaatcaaaatctttgccaataggctatgacagaatcctatgagagatgatgccatttagaactttcacaagaggcaaaaatagtatgccattggcacctaaaactgccaacagtgatcatcataggatttatttcatttggcggattcttggttgagttcataacctgttccctaggcttttaagattggtccaaacttggcaatggattctttggaaaaattatttcttgatcgttttaaactttcttttccagtgtcaagagagattttcccaggctccgagttttcatttattttttcccctgtcagtttttgaaagagaaatcccctttttgtcggctttgtgattgcttttgtgtcaaattcagcgtaaaagcttttcaaacgtgacagcattagctgttttgtgcttggctgagctaagagtacatgaattcaatagagaagtgaaatcttgtttgagcctggctgatttggctatataatattgaaaactatctgaagcaagaaattcaatacttttcaaattattgaataaacatttctaaggctgcaaaatctctgtgtttttgaaggcattctttaggaaacttgaaacacagacattctataatcacataattaattttaaaagttgaacttattgtatgtagtaactaaggcagctatttgagtgtctcaaattattttactaaaaagggagacatttttcaaatatggaagtagtgccttacatttttagttatctgtggaaggatcgatggcatcatatatctcatccaccataaaaatatgtacggtagtggaaactgaatttttcttttatatattttgtgtattttttggagttgtacaaaattaaatcagcaaattgacccacactagtagtttgaggtttgggtttctggtacaataatgaaaagcattattagaaatcttcttgccaggacctaccatttcttcatgtattttctttattcccttttgttctcccctaaagcttctatgtgattaaagagaaaagatcaataacccaatagtacttttccttctaaagtatgcatgaaactcttaaagttctcaaagcatacaaacagagtgctctctacattgctgatagaacacaggtagtaatgggctagtttccccaggtaactattatattatataaatatttaatgcagagtcaccaagccttgaataactttatgctttgattgtaccatattttctctagtttgcttttcacaatttaacttatcccgtgcttgaaaatataatgtggtaactgtgtaaatctgctcctcaaaaaattttcgaaatcatcttttcttttttcttttctttctttttttcctttttttgagatggagtctcactctgtcacccaggctggagtgcagtggcatgatcttggcttagtgcaacctccacctcctgtgatcaagtgagtctctcagcatcccaagtagatggaactacaggcacattccaccacgcccaactatttctcgtgtttttagtagagacagggtttcactatgttggccaggctggtctcaaactcctgacctcgagtgttccgcccacttcagcctcccaaagtgctgggatacaggcgtgagccaacatgcctggccccacatcgccttttctgaaccctgggaattaaccaaaggctggcaacaatttttgaaatgctgactctcaataaaaatggcaaagtttgaggttttttaagttggcctttcccgtcactttctcccagctccacagtagccttgaaaatcagtagccttgcaaccataatagctgtgaaaactagcagccttttagccaccagagagtgtagaccaggattggaattcttcaaaaaggccaattttattccaagaaccttgccactgtttgacctatcttgcagctccctggaataaacctatatacatggccttgcctttatttggcccgacttagagataactttctaggaaaagccctagctccagggtgttggtccaaaccaattagcagcaattctttaacataacaggttcctaaggctgtgatgctagttgagataaacataggtctggagaaaaacttccagtgaagctctggagaatgaggtgtccataggggattttggcaacctctgacatgttcttgcgggatctagaagcccatgtgcttgtcttaacaaatagagagtatcaataaagagatagaaattgtaaataagaactcagtggaatatctggagttggaaagcacaataactaaaattaaattttcacttgacgtcagattcaagctgcaaaagaaagaatcagcaaacttgaaaataggtaaatgggataatccaatccaaagaaaagaaagaaaaaatattaaggaaatacagaaagcaaaaactgactgaactgaaagaagaattaggtaattcaacaaaaatagttggagacttcaacatctcacttttaataacaggtaaaagaactaggcaaattaacaaggaaatagacacttgaaaaagactataaagactataaacttacaagacctaacagatatctatacagcgtttcatccaataatagcagaatactcattcttttcaactgtacacgaaatattctctagggtaggccatatgctaggtcataaaataagtctcactacattcaaagggattaaaatcatacaatgcagattttatgaccataatggagtacaattaaaaatcagtaacagatgtaaatttgggagttcataaatatgagaaaattatacaacacactcttaaatagccaatgggacaaagaagaaataagaaaatacaaaaatatcttgagataaatggaaataaaaatacaatataccaaaacttatgggaggaggctgaagcagtgcttagagtaaaatgtataactataaatacctatatttaaaaaggaaaaagatctgaaatcagtagcctaagcttctaccttaagaaactagaaaaagaagagaaaagtaaatctacagtaagcagcaggaagtaataacaattagtgtgaaaaaaatcagatagaggaagaaaatataatagaaaaaatcaacaaaaccaaaatctagaaatttagttatttgaaaaggtcaacaaaattgacaaagttttagctgattggttaggaaagaaatggtcaaattactaatattagagaaaaagagggtgcattactaccaacattacagaaataaaaagaagtaaaagaggatattatgaacaactaaacaaatagataacctggatagacctataacaagaaattgaattggtattaaaaacttctcccaatgaaaggctcaggcccagaagtcttcccccgatgaattctaccaaacatataaacaactcttccaaaaaatagaagagaaaggaacacttcctaaccagacaaagatatcacaagaaaacaagctacagagcaatatgccttatgaatatagacttgaaacgcctcaaaaaattatcaaacctaatacaacaacatattaacatgattgctaccataaccaggtaagatttatcacaggaatgtaaggttggtttaacatccaaaatttaatcaatgtattataccatatcaatagaataaaggacaaaaatcgtatggtcatcacaataaatatagaaaattcatgtgacaaagtacaaaaccctttcaagcttgaaaaataaagaacacttaacaaatgaagaatagaaggtattggccaggtgtggtggctcacgcctgtaatcccagcactttgggaggccgaggcagttggatcacgaggtcaggagattgagaccatcctggctaacacggtaaaaccccgtctctgctaaaaatacaaaaaattagctgggcacggtggcgggcgcctgtagtcccagctactcaggaggctgaggcaggagaatggcgcgaaccctggaggcagagtttgcagtgagccgagacagcagcactgcagtccggcctgggcgaaagagcgagactccgtctaaaaaaaaaaaaaaaaagaaggttttgtggattgaatagtgtcccccgctcccaaaagacatactaaaagcctgagcccaggtatctgcaaatgtgaccttatgtagaaatagagtctttgcagatgcagtcaagttaagatggtatttttataagaagaggaaaagaggcatacacagagagaagaatgccacataaaggcactgaccacgggaaaaacaccatgtgatgttacagttagagattaaagtgctacagttgcaagacaagtaaaactaatgattaacggccatcattagaagcaaggaagaggcaaggaaaaattctcccctacaggtttcagcaggagtatgggcctgctggaatcttgattttggatctagcctccagaagtctgagacaatgagttttgtctacccagctacgcaaattgtgacacttaattacagaagcccgaggaaacgaatacagaagaggatttcctcaacctgataaaaggcagctacaaaaattccacagctaatgttattgtgaaacactgaatgctttcccctaagatcaggaaatagtgaaggatgcctggtctcaccacttctattcagtattgtactggaagttcaggccagggaaattaggcaagaaaaataaataaaagacatccagattagaaaggaataagtaaaattatctctacttgcagacaacatgaccttgtaattagaaaattttgaagaatctatgaaaaaatattagaaataataaaataattcagcaaatttgtaggatacaagatcaatatacaaaatgaattattttatacattaaaaatgaataatctaaaagtgaaattaagaaaatatttacaatggcatcaaaaaatgttaaaaacttaggaataaaagagatgcaaggcttgtatactgaagaatacaaagcagtgttgaaagaaattaaagataaaaaaatagaaaaatatcacatgttctcagatcaaaagacttaatattattaagatatcaatatccccccaattgatctacagactctatggaatcattatcaaaatcacaactggcttttttttttttttcagaaattgacaagtggatcctaccatttctattgaaatgcaagggatgtagaatagtcaaaacaaccttgaaaaaagaacaacattggaggagttaactttccaatttcaaaaactactacaaagctacaattattaagtcaatgtggtactagaatgtgaatagacatatagatcaatgaaatagaattgaaagttcaaaagtaaacctttgcatttatggtcaactgatttttgacaagggtaccaagagaattcaatggaaaaagaatagtctttcacaacctggtgctagaataactggatatacacatgaaaaataatgaaatttggccccacctcacaccatacacaaaaattagcttaaatgtatcataaaagaaaacaaataatctgattaaaatgggcaaaacacttaaacatttctcaaaagaagatgtacaaatagctaacgggtttgtgaaaaatgctcaacatcactaatcattggggaaatgcatattacaatcgcagtgagatgtcaccttacacctgttagaatggctgttataaaaagagaagaatgataacaagtgttgatcaaggatatggaaaaaaggtaacacttgtatatcattggtgggaatgtatattagtacaaccattatggagaacagtatggtagctcctcaaaaaactgaaaacagaattaccataggatccagcaatcccacttccgggtatatatccaaaagaatttaaaccagtatgtcaaagagatatcttcactcctgtgtttattgcagcattagtcacaaaagccatgatatggaatcaacctaagtttccatcagtggatgaatggataaagaaaatgtggtacatatacacaatggagtattattcagccttaaataaagaatatccttttgtttatgacagcgtggatgaacctggaggacattatactaaatgaaataagccaggcacagaaagtcaaatactgcgtgatctcacttatgtgtggaatctaaaaaagtcaaactcattgaagtagagagtagaatggtggttaccagaggctgtggatttaggggtggaaaatggggagatgttgatcaaaaggggttaaaaactttagtcaggaggaataagtttttgagactttatgacacaacctggtgaccatagttaataatattatattgtatatttcaaaattgctaaaataacagattttaaatgttcttgctataaaatatgataaatatatgcagtgatagatacgttaaattgctcgatataatcattccacagtgtatacatatatcagaacatacatgtaccccataaatgtatataattatttgtcaaagcaaaataaaattaaaaataaaatgttttaaaacttttgtaaaataaactttataataataatatatttttaatgaatcatagagctaaatatattaataagaactaaaactttaaaactcttctaagaaaatgtaggaatacaatggattatgcagtgttttcttagatatgacaccaaaagcaaaagtaaccgaaaaatacacaatttggactttaacaaaattaaaacttttgtactgcaagcaatattgtaaagaaagggaaaagacaatcctcagaatgggtaaaaatatttgtaaatcatatatttgataagatacttgtatcaagaatatataaaaactcataattcaacaacaaaaaggataaatgacttaattacaagtgaagaaacagtttgaataggcatttctccaaagtagatgtatagatctccataagcacatgaaaagatggttaacatcattgattgtttaaaaaatgcaaatgaaaaccacaaggagatagtactttttacccactaggatggctaatacaaaaaatacagacaataacaagtgttgagaagatgaagaatgcttggaattttcacattactggtggaaatgtaaaatggtgaaacaactttgaaaacagtttggaagttcctggaaatatttttttaatttttaatttttgtgggtacacagtaggtatatatatttatgggatacaggaaatattttgatataggcatacaatgtgtaacagtcacattggggtacctggcctatccctcacctcaagcaattatcttttctgttacaaacgacaatctaataataatcagttatttttaaattcacaataaattttttgactgtagtcatcctcttgtgctatcaaatactagatcttattcattctatcaaactatatttttgtattataaatttcactacccattagccatccccccctttccccctaccactacccttcccagtctcctggaaatattaaacatgaagctaccatatgacaaaaccattctactcccaggtgtatgctgaacagaaataaaaatacatatgtacacagaaaacctttatacagatgttcatagcagcattatttataatagccaaaaagtagaaccaacccaaatgtccatcagctaatgaataaattttaaaatgtcctctacatccaaaaatggaatattatttagcaataaaaagaaatgaaatactgatatgcactgtaacatgagtgaacctcaaaaatatgctaagtgatggaatccagtcacaaaagaccccaaattgtatcaatacattcatataaaacatccagtaaagactgaaggaggaggagaatagacaatagaaagggactgttaattggtatgggtttcattgggggcaaataaaatgttctcaaattagatcataataatggttgcacaaccctgaatacattaagaaccagaaaattatgcactttaagtgggagaattttatggtatgttaaaaagtatatctgcatgtcattgactacagatcttttcttattttttcaagttttatgaacacagttttagaaacatagtctccatttttctctttcatgaagctgcttgccagctatagaaatgaaaaaatagccatgtctgtggaacataactgctacctagatgggagcctccatcacacaatggatagggagctattttcttttatggtcaagataggcaggttctgtcctatagaatatattctgagatgttacctgtagttcagaaaaacagggatattgttgttctaaacatttcctcaacatttatgtggcttcctatttattaataagagaacctgttctttatgtgtcattatactagtttattctagccctggtcctggtccaggactgtctggaggtattagaattgccctactctatgtgaaataaggtcatatctgaataggtatgtcagtcagcataggctaagctacagtaataagcaacctcaaatctagaggcttaatagtctatattttactcatgttacatgttcgttgtagactgatgagagcattctacttagcttagtcactcggggaccatggctgatggtatctccatcttggtacattctttcatgatcatagaggcaaggaacatggttcttgagccttctgcctggaagtgaccagtagacaaaaccagtcacatggccattcctgagttcaatgggaatgccgatgtataatcttctggcgtgaaaaggcactggatatttgagaacaataatgcagtctaccacaatatgctcatggggtctgaaaaggagctgaaaaaacgccattttctggggttctgtcctctggcattgtttctggaatcgtttccacccatccatttctacaccctctcaactgacttttctcagatgcctggggtagctgggtgatttgttaattacagtattgcttaagccttttaataaagtcagcaaattaaagagagagcccagataaagagaatgctttcaaaaatgtcataatgaaattaaggtaacgaagcacttggagacctctcctcccttctttttgtatgaaacttattccaaagcagctggaagagaaatggggcctgaaagtaaagaggggaaaaatatattgtatgccattagtttaattataaaaattcattacatgaagccatgtaagacagaaaataatggaactctaatgggttggccgataacacatttactagtctgctctcagcttgtagtcattgttgaaaggacagaaaagtaacgacgttggtatgtagtcttcaaagctattgtaaagattaatcattttcagtaagccggaaaatgagggccattttcttaaatagtatgccctgtatagagtgttaccttctgaaacagagttgtttggtaatgtcagaggtttaatagatgagtcttgaagttaatggtgagaggctttacttttgaaatggctttcttacagctattttaacatttctattataaatccataaagaggttttataggtcgttttaattcacacaaggagggaagaaattgtgcttctcttttcccaataaggatttatagaacattaattcattcttgggaccaaattgtttagtgattttcaaaaataaactatgtatttttctgctgtctttttttcagaaatgccttactttattatacataataattttccagtcatgctataatcatcaagattgttttatattcttcaaagctcagttaaaataaacccagtccttttccttaaatttctttatatggatgcataacttctttaactgaattgaaatgaaacctgaattgagagtccagaaacctgcatttttatgatgactctttcactgactagctatgtcaccttgaacaagtcacttaacctttcagagcatttatattctcatgtggacaattatggaattgctcaaaaaggaagaagatatcaaaagatgaaagtgaatatgtaggtaggggtcatatattcgagggccttgtaatccaaagagagaggttaggactttgtcttgcaggtaatagcaaaccattgaaaggttttacacagaggagaaatgaggttctatttgcattacaaaaagatcatttacgcagttgtatgtaggtggaagggtggtttgagagtggagggagggagccaataaaaaagattattttagtacctgagcaagagatgatagggacgtaaattaaggtagtgtcaatggaagtagaagatttggataaaagttaaaaaaaaaaaaaaaaaaacttatgatacaactacccagggagtatgttccctgcctcctgctccagttgaggaccaacatatcagattgatccagagacagaattttggagaacattaatatttaaaggacaggcaaaaaaaaaaaaaaaaaagcttgaacactcagagaatacagaggcgaccaaaagagtggaagccaagaaagcagagaacttcgagaagagaatagtcagcagcaccagttgctgcaaataaatcaagtaaataagaacttaaatctttccataggcattggcttttggtaactgaatcagttaactattttcacaaatgtgagtggcatatagcaataagcccatattgcctttcatgaattttcagcttgggtggggtggcacttcttcatgttgcaggttgattggggtcgctctgctccatatgtcactcattctcctcctgagatgagtaggctagtccagagcatgtttgtcttaaggtaatggtgaagtgcaaaagggatagccacactgcataaatacatttcaagcctctgcttgtgttacttctagtaatatcccactgggattaggcaaagcaaggcgcatgaccaagctcaatgtcaagggcatgctgtctttcgtaggaagaatttcagagttacttagcaaagggcatggatacagggagaggtaaagaattggggccagtaattcaatttgccatagtgacttctgtcagaatagttttagtggaacgatgatggcagaagcctgattttcatgaattggagagtggcacgaatgtagtcaagttgagataatgagtgaatatctgccttctaaagagtgtgactgtgaaaggaaagaaaatgatagagtgcagattattgttgttgttgttgtttaaagatgagagagacactcatgtttgaagtctctagagaaggtccccgcagagaggcaagaagttggaacacacaaagagagagggagtatgtggaggaggatcccagaatagatgggtgcccagatggtgaaatcaacttccaatagcagaaaagtcgcctcttcctctgagactagagagaaggatgcaagatgtaaagtctgatatttcatgaaatgtatgtttgatatattaaatttccccctgtggaattgtaggtaggatcatttactgtgagatttctttcagttcgtgttgtcaggaattagtctgtaaaccacattcgatatttcaaacagaggaaattcaatacagaggactggctcctccataggaatgaaggagctgacaaacccaacagaggacagtgaggcaacccagagtttagcaacttcaggaaactattaccacctcaagggctggggaaccgacaagttttaccaaagcccagaaaccagaaccatcgggtgctaattcacccaatgtaaggtctgcacagcaggtaatggaattacagagggagcagccgtccagtgggaaacggagacaaaggagatactgccaagacagagagagaagggggataattatcttgtttcaccctttctcatgctcttctgtctcccactagtgtgtctcatgacttaacctagttagaagccagctagcaagaaatcccaggaaattctgacctcctatgggagttagtacatctcaatactgagtggagtaggaaatgggtagagaatggatctaagagcaaacgacctcttggtggttagctaacagagttaaatttttccatgaatcccttggttcatgaatgtaaatacaggatccaaggaaaaataacaaatccaacatgtagaactttttgttcataagcatattaggatcctgttttacaattttccgagcaattgcttgattttgacacttcaggacaagccggaggcatggtcagagcaagtaaccccatcctagtttacagatgacaaaactgggacttacaaggttaatgacttccttaagatcaaactgcagaacaatggacaagcaaaacttcctgggaagatgtcctttcgttactctgcactgcctttcttgaagttcctttgagacacagtcattaaaaatttaagtaatagttcacccggaacaaacatttattttacttgtaggtgaatatcacaaaacacattttaaaaggaaatttaaccaatattcaaccttaaaattttaatgatagagctatgcacttgcttttatcttccaagttaaagggagaattttagagttgcagcatttctagacaatgtccataaaacagcgagctacttgctttgcattcagaaggggctcacactgtggggaatatagtttgactcattaaaattagtagtagatgtgctagcagtagtaatgatgatgatgatgctgatgctgatgatgattaatatttatttaatccttcgggcacgccaggcacctttgtaaatgttctccctgaattctctaagttaacccacctaatcatatttccacataaatactgttaatattcccatttagcaaaggaggaaactgaggcacagaaaagataattaactctcccatttgccactaagcgatcacgccaggattcaaacccagcaggctcattgtattgctcaggcttttagctactctttctcttcctcctctcttttctaccatgtagggtcaatatcactaaaataagttcttacacataaaagaaatgagagaagacaaacaattaaagtagaaaaaaatactcaaaattcttgaaattaattcaggttgtctcatagtccacaatcactttttctacctaagatactgtgaatatatatcaagcacatagtgcagtagcagcataatgggtttgaatgtgaaacatttctttcctggttggggaaacaatcttttggggatttagcattttatattcttcatagaaaacacacacacatacacacacacacacatacacacacacacatatacaaaggcaatctttttttataagctagtgctcacagtattttaaatttcttcacacaccatgatcaccacacaagcaattccctgtggtgtacaccattgtcaatggaattcagaaagagaaaagggtgtgtgtgaagtctgttgtatttttgaatttacactccttctgaggtctggagttatcccagtagtaaatttcacagcagtaggcaaagctggtcaaggtcatggttcctagtgtgaatgacacttgggtaaaacccaaggtgggcgggcagaatattaccgtaggagaaagggaaaacattctgtgtggggaatgtctttaagaagggagaaaaaaaaaaaaggctacctttgagaacctttgtgtttatataagggcctgagccccctcaatgtcagtcaaggtcagtgggagttttactttttaatcctacatcctcacaaaacctgggcagtattcagtgagggttagcactcagtcaagatttccttaggtataacagtcctaactttcgctgtgaatacaattttgcagaaaaatatatggcacgcgtatttctacctttcaagcattaaagtacatcaaaaagttctggtttgacgtcaagcctcactctttactaccttgtttagtaggaaatctgtcatttaactctagcttactatttctttcagagattttggaaaattctaggatatgttataatttataattttaggcatttttatgatctattgattatgtttttagattcattggcaccttctgcattttatgttttttaattttaacagctttattgaagtgtaattgatatacaaaaactgcataaaattatatgggctagaacatgtgcatatacccatgaaaccatccaaatggtataacctcttatatctagacttttcaaacaggaacctatgagtgatgggtggcttccaaggttatttaacttgcttgagtaaaataaatgattttaattatatatttactaaaaattttgtttttattttgtattcctgagcttttacatatatgctctgatactggtccatcataagtattttattaacaattcagtgttttataaaaggaattcatttgaaaaaaaggtaaccaagttattggtctcagttttgtggatgttcatgctattaattagcaatttaatagatgagagataataagctcttcttttaaaatgcaaatagcaccctctggatactaagggccaattacatgttctttcgtatcttggaatacatttcttttatcactttaggtttggcttaagtgaggaggagaaagaaagaagtggtaattttgtaccctaggatatttctagaaaaggcaagcctttggcagaagttccctcagaagggctttcaaatagtgcgaggatctgaaaagtggagaatagaaactgtaatgcttgataaaaggagtatggaagaaaaggcaggcattccacgcggataaatgttaattgttttgtaatagcagcaactatgctctgtgcctttagacactgtcctctgctttcatagcaaaagtcagtgatattggcattagcttcttgataatagtttggtaatctgggtctatttgctatatgcagtaaatactattacttggtttgattctaggatgttttagttaactgagaaattacattatatatagattgtatatgttcaataggagttcaccaaacacgctgaaattatgctaagaacactgtttgatttttattctgtaaatatcatactaacgcaaaagaacaaatattaaaacaaaaatgatttttctcctcagaagcattattttcaatttcttccatttcgtgttcagctcatgattatgtattcttagagataaacacagtgtagttaaaaattgtgttctgttttttacacaagaaaattgtgctctttttacagtgattactgtgcacatttgctacatattggaccattggaatgatgtattatgttcttttaatgtccctgcattaaacatcgacattgtttctctttttttttttttttttttttttttttttccgagatggagtctcactctgtcgcccaggctggagtgcagtggcgtgatcttggctcactgcaacttccatctcctgggttcaagcaattctctgcctcagcctcccgagtagctgggattacaggagcctaccagcacacccggctaatttttatatttttagtagagacggtgtttcaccatcttggccagactggtcttgaactcctgacctcgtgatccacccgccttggcctccctaagtgctgggattacaggcatgagccaccgcacccggcctgtttctcatttttttactgctttggttaatgaagattttaagtcatatagtatattgatcttcttttgaagattttatcaggataaagtaccaaaagtgagattattgagtcaatgggaataagcatttgtatgtcacttggtatctattgccaaattgtcctaatagataacggtccccagcagtaatacgtgaatgtgctagttttactggtcttttcagctttggattttattttttgttaatttaattggtgtccaattgtaccttttcaatttaatactctattttttattacttgaaagttaacttttttctttttaaataaaatcatcccactctttctcttgtttgaactacctgttcctattcctgtgtccatttatcaatgacttaacccatcctattgaatttgatataactatcttaacaattagtattatcttaatgcttagaagcctcctctctgcacttgcagaaatgtttaatagaaatttcaggttgatatgcttcgagataaaacctaccattaattgacttctttctttgaaatatgtttcaagtgatgagatagcaagtttgaaaacactgaattgccaaagacaaacaacgaagaaaatgtaggtgatttggtttagtaagattcttatattttgactttttttctaattttaaagtaaggtattctaaaagtattttgatccttcaaaaaattcgtgactagaataacagtactattcttttgttgttcaatattttctgtatgcaggtttagttgaacgccagtagatggcactaattacataaacaattcaacaagttaatgaagagggaaagaaatgtatgaggtttttttcgttcaaatgttgttatatgtcacatattcaacaattatatatgagcttatttttgtagtttttttctcttgtgataaaaacaattaagcccactttattgccaattaattgctactaagttgaaatacttgatactggttattgctcaagatgctgcatttgaaaagtttgtcctgaaaggtgggttaccttatactgtcatgattgactaaatcatatggtaggttaaaagcaatctaatatatgtattctgacctgaggattcagaagctgtttacgaagtattttaagacactccaactagagatttcataaaaaaaactgacattcattctctttctcataaaaatctatagcagttggccaaagacctccgccagtggcagacaaatgtagatgtggcaaatgacttggccctgaaacttctccgggattattctgcagatgataccagaaaagtccacatgataacagagaatatcaatgcctcttggagaagcattcataaaaggtatgaattacattatttctaaaactactgttggctgtaataatggggtggtgaaactggatggaccatgaggatttgtttttccaatccagctaaactggagcttgggagggttcaagacgataaataccaactaaactcacggacttggctcagacttctattttaaaaacgaggaacataagatctcatttgcccgctgtcacaaaagtagtgacataaccaagagattaaacaaaaagcaaaatactgatttatagctagaagagccatttatcagtctactttgataactctatccaaaggaatatctttctatctcatcatggcgcacactgccttacctgttatctgataaataagtcactttgggattcatgatagagttatagctgtacatggtctcatcctagtatctcactccacacacccaatgggaaaatttgtggagggcaatatgactcgtcacttcatttcccattatatatgaatggaaattaacagcgcttatagacagtatctcctcaaactaagccttgtatccttattatacctctcttgatctctagtgcttttttcactagcatttattccaatcataaataaaaatataaattatgtaactaattgttaaatatttgtcctttaaattaatctaaatgccatgagggcagagattttgtctttctcatttgatacatccccaggtcctgaaccacgtgatataatagggagctagtaaatgttttttgaatgatgactccctttgcagaatgtacaattaccttgtgcaagctgaaaaaatagcacctgtacaatatgaggaagaccacggtgaaaaataattgagttccaaaatatgacatcaattactgaaaaaataagctcggtgatttttaacaagaagtaaaagtcaccactggggccaaaacagattttgaactaagagtaggaagtcttaggagaaatgagataatgatatatggaaattaagcggccaactaaattttgaaactgagctagacattagagagtaaaaactcctgtgaagctgaatttaagctggtcaccctggggaatagagcaactctaatcctgaattccagacagtaggtgtatagatggaaaagaccatggaaaagaagattcaacctaaagttgggaagttttaattggagccctatgaaaaagaccctggtggagaaagggcaaacttgaatatggagctgatatttggaaaaattctcatagtaactactttttctcaatggcaaggcttggactttcttctcaaaatacagatcttatatgtgttcaattaaacagggacagattaggttcaggaagaattattcacatggaatcaattggtatcagagagtcaaccattagatcttagtgggaaatatctgcttctcaaagagaagtcttttggggaaagcaaattaaagtcagagattaatttgatgagtttaggtaatataaactaaggggccaagaaaaaagcttgctcatggtatgaaactagagcttgaggacactgatctagtctatctatactactctttctgacagacccctctcttcattctcatgctccttgatggcccaagccactctctcagttttttaaaaaattgttttatcaaggtctctggattcttcatgggaatgacttccagtttatattttttggcttggttccaaaaagctatcagctaaggaatgcatatacttacttcccctatgggtaaagtaaatgagaattttagaagccaactcacatttttagcctgtacagaatctgcaattcaccaagctacttctgactcatgtctataaagttcttccctgttcttttctcacttcacatgtactctttgcaagaattcatccacttgtgtagtttcagtctgttgatgactacccatctataattccagctgagaatgatcttttgagttttagacatgtagatcctgctgctttctttcgatgttaatgtcccacaggaacttcacattgaagaggtccaaagctaaactcatctttgccttcttccaatctctttctccaaatgcaacctacttctgttgtccttgtcttagtccttttcgtgcttccgtaacaaaataccacagactgggtaatttataatgaacagggatttgttggctcatagttctggaggctgcgaagtccaagatcaaggggctggaatctggtaagggccttcttgttgtgtcatgattccatgatggaaggtggaagaccaaaagagagaaaaaatggggccaaacttgtccttatatgaaactcactcccacaataatgatgctaatccgttcatgaaggcagagccttcatgtcctaatcacctcttcaaggtcacatttactactgttgcaatggcaattaaattttaccataagtttgggaagggaaaaacattaaaccatagcattctgcccccttttccccaaaattcttgttcttctcaaagacaaaatacattcatttcatccccaaagccccaaaaatcttatttcagcataaactcaaaagtgcaatctaatataaattagatatgggtgagactcaaggcacaattcatcgtgaggcaaattcccttccatctctgagcctgcaaaatcgaatcaagttcatcccctcaccccctacccttcccagcatcaggtaaccaccaatcacagaaagttttactgatagtcctgctctagatcatctttgtctatgttcactttagctatttatcctagtgttccattattggaatactaagcatgtgggaattatttatattctactgttcaaggtcctcaccaaggtctgattgcaaaaattcaaaaaattgcaaccttaggcataaatgggttaagcagtttagggtacatttataataattatttactgtgctacttcaaaaatcttattgcctctatttataaataaaaagtgttgtctctacacagtggcttgttgtaatgcatttacttgtttctgcctgattttttctatttatacattttcttttttatttttatttttattttttcacttttaagttcaggggtacatgtgcaggtttgttacataggtaaacttgtgtcatgggggtctgttgtacagattatttcatcacctaggtattaatcctggtacccgttagttgactttcctgatcctctcgctcctcccaccctccacactctaatagtccctagcatgtgttgttcccctctacgtgtccatgtgttctcatcatttagctcccacttataaatgagaacatggggtatttggttttttgttcctgtattagtttgataaggacaatggcctccagatccatctatgtccctgcaaaggacatgatctcattctttttttatggctacgtagtattccatggtatttgtgttggtctcaaaaactacaactatgacaggatggcattttcacttttgttgttatattaaactcatcttaaaaaggaaagattaataatgtcaatatttgggttatggagaaaaagtatctcatatctttgaaaaagttctgtaactatagctttttaggtaggagggattctgtggaaagttttctgattacatcatttctcacagttcaggttagacaccattttactatgaaacactaatgcattgcctgcactgagactttcagtcacatggagaaacctaggcaaaatttttgtacacttggaagaatatttaaattagtaataaaatctttagttttaaactgttgaatgttaaataagatataaaatgtacttgaaagaaatttgctttgatatcagacactgccatgttgcagtttcaagacataataaaaaagtaaactaatgtttatattttgctgtttaagtttattaatacatcagatgagtcttcaaattctacagtggcttttgatatgatcatttttacttgccattttatatagaataaatataaataggcatttatgcttaaaaggaactaatctatctatggaaaaaagagaaggctgcttctcaactaaattgtacagtttagaaacccagatctgaacatagattattgttgtgacctatgtaggaaaatatgttgttttccttatcgtagtccttacagagtccatgataacatataaagccagaaatgtgagcctctgcaagttcatttctttgtcttcaatctctgtgaatagatatgagtttgtgaataagataatattagatgtgatattacaaattattgtgagaagcctctaaggattagatttcaaggactgccatctggctgatgactttatgatgacactgtcatgagatttcatttccttatttctgttccaggatcactctttaaacaagaaataagcattaactctgaattgtctgcttgtagctgtatgagggcttccacaactgccaactagccaggtacaaactcatcaagcagaggagatggtccttgcatcagagggttaaacatgcctagaagttccttagctaagctcccagatactaaaaaatccctctaggttctaagaaagattcagcatgtacatgtgtgtacatgtatgtgtgtacatatatacatatacgtgtatatgcatatgcatgcatatacatacaaacacattttcttccataacatctcagtattctctgttctttataatactgttttgtattttaatgatcaaaattaatagttgatcatctgaaaacattttgacctgttttctccgtctttgacaaccttgaaggcacttgtaagtcactctttgcttctctattcctaggtcctttctcatcttcattgcaacaagaaaagagaaaacaattgagccctattttgtgtgtagcaaggagctactctagttaaacactagatctcttttacattctccaacatgttgttttagtaattattctactttcctttttttgggatattcaatttcttctttctttttgctcctcccctttagcaggccaacatactcaagtctccctcatcctaagagaacttttttagtatatcattttttttctatccagctgtacttgcttctgcttactatatcatttttaagcagtagttggcattactgtttcctgttctttagctactagttgtactttgacccactccagtctcacttccccagcaccaccactttatgaaaacaaggacttactaagatcatcagtgactttgtaatagctaattagtgtattttaattcgtccatcttcttgactatattttaacattgatcctgttggtcaactctgctaatcaaaactttatcctccttggttcccagaacaatattatcttgaatatctcatttctctaatcatataataattgtgaggtgcttggcacaatgcctagtgcgtagtaagaactcagtaaaatatcatctgccatcgacaccataaaaattaatttacttactcaacaaatacttttgtatgaagtttgtgctaggtaggcccagtaattggtacttggtatagagcaatgaaaagccctaccctcataaagcttatattcttggaagcagaagttggaagacagacattgacaaataaaaattaaatacatgatgtgtcagatggtcatacacacagtgtggaagaacaaagaggaaaacaagtggagagagagagggaggtggaagaggagtgctgccatgaaaatgtggtaatcaaaaaaggtcttactgaaaaggtggcatttaagcaaattctaaaagacctgaggatgtgggccatatgtataattgggggggaaaaagtagtccaggagagtcctaataagttaaaatgccccaaagcaggaatattcttggcatgttgaaggaaccttaaaagggagatcagttaggcagaaaaggatcaagcgagcaggaaggtagttgacaataaatttagaggggtaactggcatctgattatattggccttttaggcctgtggactttagcttttaatctgaatgagatgggagttattggagggttttgaatggaggagtgacatgttttgtcttatctggctcctctgttacaatagactaaacagaagtagtgagaccattaggaaactgttgtcataattcagtcaagagatgactgtggctgggatcagaatgggagaggtgaatgtggtgaggagtggttggattctactatattttgggtacagagcacaacagattttataatggaataaatttaggtgtgagagaaagagtcaagaagactcaagaatttttagcctgagcaacggaaagatggggtcatcatttactgagatggggaaggctccaggagtaacatattttgggaggaagatgtggatatgttacatttgaaatgcctattatacatctaggagatgtgtggagtagatagctggatatatgaatcttaagttatggggagtagctcaagatacaaagttgggagttgtaacaatgatcagtgcaagttctctgtcttcaatgcaattttaaatgttgatgttccattcttaattgtctctcttctttctctctgcacattttgagtagctttgtctgttggcttcagttaacattaagactcctcagtgtcaacttccatcttacactcttctcctgatctccagaactgtactttctgccacctaacctacattaccacctggatatgctacaggctgcaaaatgtgtcaagtagaatgcattatcttgcccctaaaagaaagttaaattttctgtgttttcagtgtagtgtaattgtctaacttaattgtctctaaaactggaaacctaagaattaccttctacctttctcttgatctctctttcccaatctactgacacatgtattaaactggcttccaaattctgtgaattctacttcaaaaattgctctagaaacaattccctctctttatccctattgtcacctcatcctaaagcctcttcatcctttgtagatttctgggagattgtaaccaacttttctctattctgccagttatcaagtctttacgctcatttgacattcacaacagccttggatctgtcttccttgaaatgaatcttcttgcttccctttgattccagtgctttttttttaccctcctgagacttgatgcatgatatttacatgtatgacatgtttccaaaagcattctcaaatttttctgaaagtaaaaacaaatgaaaaagtaaaacattttcctgggaagaaaagcaaatagtgttatacatttttgcttgttcatttgtttgtttatttaggagagggacaagcattagaacttcataagagtcttatatgctgtatctacaaataccgtcccttggcaatataattttagagttccttttctggaactacttaaggactgttttatgatcctcagcagactgttatattattttatagccataccttttatttgctgagtaattgtactcaataattgtttgtaattgaatgaaacaattcatcagatgttgggcactgaatggctttggattatttccaaaaatttaaaggataaagatttgctgccttcaaagctatgtacaaaaatatgatagaatgctagcgggatatttgtttaaaatacaacctttattacattggggcctgctcataatatatatgtggcacattttatttaaaatattaaagttcctggtgggacatgtccccataatcccagcactttgggaggccgaggtgggggtgggaggatcactagaggccaagagtttgagaccagcctgggcaacatagtgagataccatttctacaaaacataaaaaaaaaaaaaaaaaagccaagtttgtagtcccagctacttgggaagctgaggcaagaggatttcttgaacctaggagttcagttcaaggctgcagtgagctatgatcatgccagtgtactccagcctgggtgacgtagtgagactccatctcttaaaattaaattaaatttaaagctacaaatgaccccaaagccaccagttcaaccctctcaattttgaataccctattttaaattcctcttatgcgaaatgtaccttgtagtccattttaaggactgagaggatttggtatgttaaaaaattcaatccattatcaactcctttaggtacacttagcagtatgaaaatgtgtctttcggctcttcaggagagagtcatatgtatagttacaagacaatcccatttttatattgctgagacccaaatcttcccaactgattatgaagcataagaactcttcggaggtttaagtgagctgagattgtgccactgcactacagcctgggcgacagagcaagactttgtctcaaaaaaaaaaaaaaattctctgcattctacagtagggtaatataacatctatgatgtgaaatcttggggctccgggccagagagtgtcatgatccatatggatctaaaaggttcatagtggtaacagcctgcttcattttatgtcatctcctttcaagtaattagaatgtttctagcttgcagggattgcacacaaagggagacatttggaaccatgtcattggtgatttactggtgtggaaaattacctggtgatgtagccaagtagccattttcattctaacccagtcctacagtcctgaactgggctgaaccaacgcaccaaaatatatgcttagaaatgctcctatgtatcagttttcccaggaaaaacaatagtattatcgaaaacttaccattgtttcctaataaaaaattataggataccaacagactgttttttgttcataaatttaatattacagtatcaaatattaaagcaaatgggagaaagtttttcttatttggtttaattgaaccattaatgttagctacaatacccatcatgttacttttcaattatatttatattttcattttatttctatctgtatcattctcagaaagacttctttaaaacattcaataaaaatagaatttaggtagatttatttttagaaagttgagtttttttaataaatgaatataatcatcacttgacttaatttttttctgcacaattctagaaatcttatagttttgggatcctttggctttattcagtatgtaacagggatctgtttcctttctctaaatcattaattcaaatgatttcttatattaaaaatgtttggacatataggtattaatgagttttatgaaatctaatctttccaatttccccctaaaaagggatgtcatttaatcagttctaggttgtgatcaatagcagatttttttttttttttttttttttttttttttttttttttttttttttgcagctccctttcaccccgtagggaaacctgatatcatccttgactaattgcagcaaagagcctggctcaggtcctttgtcttataccgagtgtttatagattcttgagcccagcagaatctgaactcctggctactgctacctacttcccagcccaggccccaaaagccctatgtctgcagccccgtgcaccactgtgtgtttttgtggcatttctgaaacacagagctacttaacttgtttctaagcccagattgtgcctttttgattttctattttggtattttatctaccatttttctgtgtttggatgtttcttctatattttgaaataacttctttcctttagtacaagtgattcttattgtagaaactatcaaaaatttacaaataaagaatcattctcaacattcttagcaattccttctatcatatttttgcaaatatatttttgcctatttttattttacttactccctgtttattaacagttaaaagcattttcagatagttttattttttcatttaaaaaaatcttaccacatttttattaggaaggaaatggacaggtgtttatcttttcaataaaaaacatgggggaaataatttcttgaagtacatagtgacattcttccagccaatgttttatgctgtggtcattccgtctgtcatcagtattcatagaaagagatgaaaattatttaaattaactaggaaatcaattccccattcaaagcagtagttgtgtgtttcaaatatcttctaatagtcagtttcacacttagctttatcaaattcctaattatgatactcattacatcactctgtgtccagtcagtgtgtttatgccacagagcaattaaagcaaatcaggtgaaccaaattcaatcacctttgtagataataacctacgttgcttaaacttatggccgctcatacaattactgatggattgcctttttcttttatattgccagtattttaaatgtcctagtgaagttggggtagctgttgaacttcaactttatcacaacctcttttttaaaatgtgtaaacgaaaaaaccctccatgaaatgaccaaatacagttttcatgctgggacaaattagatgaataataatcataaattcataatgattatttatgattttatgtttttatagtgagatatgttttgttgaaatgtgttatataagtgatacttaagtttcctattaaaatagaaatgctaaaatggcattgttctctttagctgtgagtctagcttttgacctctgcttaaacggaactgttgttccatcccaaatctgcaactctgaggcctatgctcccttcactgctgtctaatggatacctatcaatttggaaggaggtttcaggcagctattcccggtaatctaatctcagctctgtccttttcaatattttcatcagtggcttggatgaagacatagataacattcttatcaaatcaatgccacaaagcagggagaaatagcaaatatagcagacaagagtatcaggagccaaaaagttttcaacaagttggactggtaggctgaatactgaaagatgtaatgtaaatgcaaggtgctacatgtgggttcaaaagaaacatgaaacaaaaaacccatctaacttagactgggctccctggaaatagactaagatagagagttgtgtgcataaggtttgttgaggagtgttcccatgagatacatgtgtaaggttgtaagataggcaagattgcacagacgaagaagtgcagtgaagcctgcagtgcgttgcggcctcatcagattttcaggggagttctggaaattgcatggccctttagagacacgctgaattgaagcaagggatctggacctttgaacccaatactagagagttaatggtcctgggtcaccccatgggaaagagcagactggagtaagattgttacctacagctgaaggcaatttccagggagggaggcagctgtgagctgttagtagtcaatattccaaccagctagggcatgaggtcttggcagagcaacagtgtacccaagaccgcagtgttacccaaagtatggtcctctgactggcagcattggtatcacctatgagctcactagaaatttaaatttgtaggtcctaccccatccaactaaatcagaatctctggggatgggacttggggaacttttaacaagctttcaggcctccaagttatttctatgcatattaaaatttgagaaccactgcctacaccaaccaaaaacattccaaatatggagataacatagagtttttagcaacaataatctccttctgtttcacttctctctttacacacacacacacacacacacacacacaacacacaacacacaatgtgatagaacagtgggaaaggaaagccaaaggggatcttaggccgaataaatttaagcatataacctagtcctaagaacgtatatttcagcttaatagagagaggaatattgttataaagctgtccaaagatggaacaggctgccttgtaaagttgtagaagtattcaggaacaggttggtgataccttggtggttgtatggtataacatcctgatcttcacatactcatcatctagagtgggagttttctttttccaaatggggttttggcagaactagttccactgtatcttaataagtaataactcaagaaagggttctatggatgaaaaaatgattaggtaatatcaagttaaatcaaagcgaacagacttctttcccataggagtaatcagacccttattacagtgcatgcttggtgaatcaacaaagtatgtgtatttatgaaagtatggggggaagggataatctatacagtatgcatcccttctaaaagtttgaccatgaaaacaatttctcaagaatcttatacaacactacagtatctggtccaatactatgcatagaacatgcactcagtaagtgtttgtaagatagatagcatagcatataggccaggccactgaagggaaatcatctcaccgtgagttacctgaatagtattctctagtgccattagctcaattcttcacgtaggcataagcctatacatttgccatgctaaccaagggaatttgtgttacgtgaattttgactctattcagacatttttttctatgactcctccaaggctgttattcttacctcatattctggtagaagtttaaggacttttttctgggaatattgattaattagctagctagctagagacagagagaggatagagattgattctctggcagagcctatttgaatcatattgaatctttttttttcctgagacttcccacaaggaggatggaggagaaattttttagaaatccaccgaagtaatcagggatatcttcagtaaaagaagctatacttaataaagtctctattttagcagatggcaatcaacaatagaggcaatagacaatagagtctattaaaattgctgggatctgctaataacgtttttcttttccctgaaacaaatgccattaaccctccttgacactctgtcttcatcaacattctaatagaatggaagtaactcataattttgaggatttttttcccacacaaaacctataaaccacaccacgctagtgattacttttagcctagttgctaggttgctgctggtaacagtaaaacttatcctgacaggtaggcaattccagaagcccagccaagcacttggtgtgtgtgagtaaacccccatacacttctcatgtagagtaaccctggccaacccataactcttagcaactattcctggtggacggacctggtctactctaagaagaggccaaggttctttaatagtgcagttgcaagaaccagaattgaaagtcaaagttctagcaagattttgcagactccttggcaaaccagtggcttgggactcattcttgacttcaagcccttaattgataatggtaggacagcttgcttgcgctgggttctgctccctgggatatgcactgtttgccaaatgagtagcaggtggacagacatctttacaatttgctgtcccatattctaaatgaacgtgacattctataggtctgagttaacctatgaagtcaccaatttcaatatcaaaatatttatgacagagaaaaggatactgaggcacagagagtctgtgactttcctaagctcaaaacaccagtttgtgttaattctgacacagaaattcttgtatttgctatcagtctcctttttctgtgtgtgtgtgtgtttttacattgcagcatcacctatatgatgttaggttctgtaactttttgagaattttctcacatacagtgatgtgttactttttgatatttcaaatagttctagtaagtcttttctacttttattagcgtattaacatactggctctaagagggcatctcaccacatctttgccattcttcctggaaaggcaagtttctctccatcttcttttttgtattccaaagttttgccaaagtttgcttttgaaaatgggttacctggcagagctttattattctaactttgaaagtacaagtcagaatcagacagtggcagttatatatgcactactgtgattactatataatgaaagtatctatggtgaaaatactgatactgacatatatttgccattttctaattaagtgcttcagtaaaaattaagcactcactctttgccagatactgcaatagatattgagcacattgaacaaaattctccatatacatatatatgagtccacattctatgaaagtataatgtttttctgagaaaaggcataatattctattaatatcagcttttgcttcttccaccatatattgaaagaattctgaatactgttataatttaatgggagaatctagagaattctgtatttgctttcactgcattgatgaactaagatttttaaaaaatgtattcttcatagaactacttttccatatttacctaatattattcttatatcatttgagcacatatttcactaacaaaacaaatgtgcaatgttattagttctaacatcaaaattacactgatactttaatttttatcctattatttttcatgcagattaaaataattatagctacatcacatgttgcaagttttaagagctactttaaaaatatatgcttcaggaaagacatgattagatggggaaatggatgatgttcatattttcaaatgaaaagttttaaaaaagtgcctatcacaaacactaaatttttacataaattatcaactactaatatatctacaagaaataccatttttccctacaaaaactcttaacaataattgttaaacttagtcctggaacctgctaatataatcggacaaatgttgtcaataagaaggtgaaaaagaaagcatatatagtttatcaaactataaaatatagtttatcaaaaccaatttttcctattgacatttattcaggaaggaaaatggatgagtgaaatgaacaatggtctctaagagaggtgggagatagcaataaattcagaccacgtttcctgtcattacagcagggaagtaaaagagctacagtcaactctcgaaagtacttgggggaactaatgattccctgtagacctgtgatgtttttgaaatttaattcaacaatttgatatacaccgcaaagcgaacagatagtcagatcaaaatcggaagaacgattgtctgaatggcatccatttttcctagatgtgctgtcccatcctgtgtcaattaaactttcaggtgatcttcaaacatatttccaagtaaaaggtattgcagttatcctataaactggcctcttccccagcactgcttttgctgtggtcaactttatttctttgggctcacaaaactgatagagcaaaataaggaaaacggaacattggattaaaataaattaattcccattctgtgactcactaaaaaaaaaatgataactatgcttctgtgagcattaataaggaaatgaataaggaaatgaccaaattgttcagtggacaacttgtatgggatttttaagtattgtgtcatcatcaatgttgtcaattagcatatactttgaaatcaactaaagcaaatcagttgactaatcattaagggtctttttaaatgacaacatctaaacagcaaatgttttattttggaaaatcatgacagcacaagaatgagccagatgttttacaacatgatatccataatttaaagtatgtagtagtcactcaaaggatttctatttcagtttccttatgatttggctaagctagaatttggaaaaacactttaaggtaatgtgagaaacagcaaaattcaacatgtggattttttcactaaagcttatttctgattattttttacaaactttactaggtatatgttaacttcatgacacttatagcagtggaccgtagttttaataaaatgtgaatgtatactcttttctcaataatattaaagaatgttgactttcgtgaggatatttttatttttctcaacattaagaactgtcaaagatttaattctacaacagaagacgtgaattttgttttctaaaggagaacagaatctatagaagaagtgttgctcatagtactcagattgttgaccaatcttaaaggagaaaccgtcaattaatttaccgagaagtaataacattatctttttcttcaattatgcacatccacaaagatttggggcaaaatccacttaaatgatattatacataatagatgagtattcatatgttgtaagagtcctggcttctttcctgcaaaatgattaaaacttggatcagaaaccaattaaaaatccattctaattcccaaatgtatgtaactgtactataagaaaaataaatatttcttcttgagggatatccattagttaaggatattcataacatggtgtcttgtaggaaatgttaatctttgggtgaatagggatgtttgggaataacaagactcaaagagatgttgcacttactcacttttctctgagttgttatttctgtcatttccccagtgcgcctgtcctcaactttgcctctctccttattcctttttttttttttttttttttgagacggagtctcgctctcttgcccaggctgtagtgcagtggtgcgatcttggctcactgcaacctctccctcctgggttcaagcaattctctgtctcagcctcccgagtggctgggattacaggcacccaccaccacgccctgctaattttttttgtatttttagtagagacagggtttcaccatcttggccaggctggtcttgaactcctgacctcgtgatccacccaccttggcctcccaaagtgctgggattacaggcgtgagccaccatggccgatccctccttatttctttttatctctacctctgcctcaatggtatttctctattactgttagcatttgctttctgtgagctcttgcacactgtcagcttatatacatgttcctgttcacatgttttcctgtccccagtggttacaacatgtcttctatctcagcccactctagaattgtcttacttttccaggtctcctgctcctcagtatttttcccacttttctagattcatgttttcccatctgcatatttctcttccatgtctgcactgtcatccgcttagaagacagcgcataaggacactgttatctgagcaaatcttcagcacagccaccatgaagcatggttaccttgtcactttccatttttcccatagtgtgtgcaaactgccctgatctgcatagaaaggtatcataattgaggaaacaaaatgcacaaaaatgtccttggttattccacccctcagaaatataggagagaagtaatttacagaattacacagaataacgctatgtcacatggacatggagttatcgggttagcatataattggaaaatatttcctaggaccttgacatttactcactttttgttttcaaattacatgtccctatctattagttgcaaattattttaatgcaccgtttaccaaagaaaggctgtttcttctgaaagctttcatttgacaagtaacttgtaaaaatattcacattgtgtatctgttttccccttctagtccaaactctagttatcttaaactttgcgcagttataaaaaatcataacaaaaaaagcttcctcgttgtcattcttgtcaaaacaggtttaccagacttaggtaaacttaaaatagttagtgtaaaagttaaaaagctgatttgctccttccagcgtgtttgttgcctttttgccacagcaaaattgtaaatgtaaacgtattccctaggagatgagctgggctgcaattttcagctaattgggagaagcagccctgagttgagcactgtcaggctgatttgagtcttaagatatgatgatgattattgtgtcaaatgtaatcaagaacgtgggctctgaactgactcaagggctggctgtttttaattcaggttcgtatatgaagtagacctccggttcaccgatagtcacagctggttgtagaagagagcaatttttaaaatgctatttcattctctatggagctctagggatcagagattggatgcacagggaggggacacatcctcattctctcctgaaaaattctattaattttcagtataataaactttctcttgagattccccagtggctctgtatcggtggttttcaaacttctcagacccaatgccacccctcttttcttttttaaataacaaatactttgtaataccttctttacgattataagccaaaatatgtagacaacataccctacttatacaggcaatagtttaaatgatgccgtaactctattttaaagagaaataagagtcatttataataaaataatatgtgttgtagtatgcagttattcaggcaggatcacactggaacacaagtgaagtttttagatcacgagactatcaatgcagtataaacaaatgcagaatgacaccattgtgttgtatggagactcaaataccatgaggggcattggtcatccatagcgtaattttccaaaatgctgaacaactcttggcaaaattcctaacaccatgaaataaattttttcttggatcgttatggcagttagttgcatggctgaaaaattcaatgtcttaaaatcatgaggaaaatatcttatgtttacgtgtaaaattgagttacgttccaggtttaggtgtttataaacagggtttccacatacatgcatgtccagtgggatattccaaagtgctgtcagacttgggagagttctttgttgtataagaagtctaccatcttcattccctctccacagaatgctattatagtaacactcttcaatcactgtgatagtcaaatgtcctccctcaatttctaggatgcctcttttttttgtggtctgtataatttggttaaatatctttccagacaaatactgatttgtgaattaatgaaatagcagtattttcggagcacctaacctatttctgagtgatacagttgccatttttacaagactaaatgaaattaccatttcagacctgccagattgtctagcccagtcttttacaattctgtgattatcactgcaattataatctattttcaccacttgaatggcatgatctctataaaagggtggtgataacactcatctattctccttcccctcacatagctatatcaatcgccccctaaccagttgttgataaatgcagttgaattttatgtaaaaattataagagatattattgtagctgtccaagacatttaaaatgctaaatgcaacttacgtggaggctataagagaaatatgaacccatttattgaagagattagctaatttagtaaaacaacacagatatacctgcatacagggataaatccctattgtctaaattattgagataaaataatgttttacaatgaaaaacttttagacaagtaggtaagtaaaatgcagcagtctatttgcatttcatctgggcatttgacaaagtctttcgttatactcttgtgaataagttggagaaatactggctagatgcaagataaattggatggcttagaagccacttcatgattttacgcaaaggatgtcgattaatagaccagtgtcaggtggtgatggaagatctctggtgctatgtcacaagcttctgttctcaaccctgacacactggatgtttttgacagaacatgagtagaactacagagaggaggcccatcaaacttatgggtgataaaaagcagggagggcaggagtattttgggtgacagaagccaaatgggtgtctggacaggatgcgttttaaggcacttttggtacttgatgtctgaagaccaggatcaaacttataggcaatctgaacatttgccaaaataacaggttaattttgacagaagttattatttgtatgctgtctatttctttaatacacctagaaagtattgaaataacattttttgcagacactcattttgaaaattcagaaaaaaaattgttaactttcgtggaagagtaacagaaactcagtcattgacagctaaatacaatgtgttgcccagtaaaatagtccaccccttcactttcatggctaatataaaatttgatgaaagatacaaattccaaagattgaatatctgtacatttgcaaagcaaaacacaattttgggcacagaattgctcattctcatttttaaacatcttggttataactgaacaatagttttttataacaaagataatattttcaaattattatgaggttcaactgaaataatttatgtgaaagcaatgtctaaactctaaaattctatataaatataaattattattcaataaattcacatcaagaaaattttaagttttttaagaacaagagcctatggccttgtttttagaagctgtataccttatcggtagtaggtttattgactttaattaaatttattgagtatctattaaattgccaggaactgtggtgtgaatctttgccctcaaataatttacagtaagttgtggttgatgaatggtgatgacgatgatgaatatccagactatagtaagtggtatattcataagtcagaggattcttaaaaccagatgcaccctcagattcattcctttcatgttgtacttctaattgaaaaaaataaatcctaaattatgactgttctttataaattttaattgatcttataaaaggccatcaatacatttcaaagtatctaggtcttttaaatgcaatttttcaccctggtaattaaaagtacgaaagcaagaaactttaaatctttattttgataagttttaattagctcaagctacttgtaatcccacatcttgtcttgtaaatcatatctgagccattaaaataggtttacaattagaagggcaattcttttagaatctacttaaactaagtcacttcgacaaattaattcatcgttcagttggttttattaaaatgtatttatttcactgtaaaatgtctagtaaagcaatgtatgaagtattttattttcatgttagaaattttatgtaaaagatatcccaaaatacatagacattcagatactctctgtatcattaaccaacatttactaacttatcatttagagaaggccaaaattgtatgtactataactttgtataatttcataagaattaaaatattcgattaatgcctgtaatgccttctttctaaatcaaatcctcaagcttacctcgagttcaaagttcagtatttattgtaacacatctcatagatgacggatgaagatggtaagcaaaggaataataatttcttttctcttttcacacatatatacacacataccccataatcctaattcatataataataacagaaaacaaagggcttttgagaatagtgacatattaatatccattatatttacttcacagggagactggcaagtctaccttgagaggtaatgtcttatagtacagtggactagattgtttcaagatttgtcatttattttggcaactcacccagcttccctgaaagttaagttcctcatctataaactgttcatgataattacaacctgcctcattagcctcatcaagctatttaaaatatgaaaggaggtgctatctgtggatcctgtcaaaggagcttgaaaactgcagaacattattttagtgtaaaatactataacaatacatgttgaatataaaatggctttttcttaacttttattttaagttcaggagcacgtgtgcaggtttgttatataggtaaactcatgtcatgggggtttgttgtaccgattattttgttacccaggtattaagcgtagtacacattagatatttttcttgatcctctccctcctcccaccctccccactccagtaggcttccacgtctgttgttcctctctgtgtccatgtgttctcatcatttagctcccactaataagtgagaacatgcagtatttggttttctgttcctgcattagtttgctaaggacaatggcctgcagctccatccatgatctctgaagaatctccacactggttttcacaatgactgaaataacatacactataaccaacagtttataagcaatgctttttctccagaacctgttatttttgactatttagtgatagccattctgactggtatgtgatggtatctccttgtggttttgatttgcatttctccaatgatcagtgatgttgagctttttttcatatgcttgttggtcgcatgtatgttttcttttaaaaagtgtctgttcatgtgctttgctaaaagggccctttcaaatgtgtattattaaccacaagagagtactgagtaagagactaggtaataaaagtcacaaatatttcgatatcataattcagaatttagatcagcggttatgaaattgttcgtatttccaaattccactgacaggactctactataagtttatttcatctgttgatatgtttttagccacttctttcttttaaagtgaatctgttgtgtgtttgccatttgatattagaaaactgaacctgcctgctttgctgtcttctgaatattatgtatcaacaactaacaagctacagttagttgttttgttctgtttttctctaagttattgtggatgaggatatatataactgcacagtcttatcaggtttgtaagagatgatcttaggctcatcttttaaattggtttttatactattttaaacaaatccttttaggagagaagaaaagctgcttagtctatcaacattaggaaatatatctttaaagagtttatcactgcaagtaaccaaagccaacttaaaaattcgcattatacaaatcattgagaatttatttagaacagaaatgtgtccaactataggtcaacaccaattttaagtgtgtaattatctgggaagtagtgttaactgcatttttttctaaagatcccttacagttgtataaatgcccaaaaggatattttgagtctctgtatattaaccaaaccaaatgtaattcattactcccaacattatatttcaacctctccaaatagtaccttttcgtattgtatcagcagaaaaatataaaatgcagatcttaaagagtatcaatctctttaaaaattcaagaaagaaaaaaatatgtgtgtatagagacgtgtatttcatctgctcataacactgtgtacatttctttatcaactaatttttttcagtgatttatgagttgaaatacaaatcaaatgaaacgggtaatgcaaagtaaagtagaaaacacattttctactgctgtctcctaatgcaggtcttttcaggaaagtactaatggttttagggaaagtgtataattatggttgtttccctaatgataaattcgcaaatctctattttaaaaacattcataaggttaaaaaaatgagagatgaaatgtgtctttcaaaattccttacgtgattgataatgcctatactctcttactatctaaagtctaggtgatatgtatattttttttaaaaaataaaatgtctgtatcagtgaaggaagtttacacagatagcttcaaagctgtggtttatctttggaggattaatctatttctcatgccagtgtgttgctactgcacatgttaaaaagtcatcctgtggtgtctggggtgacaaaagatgggaatgagttttctgagaactaatcagcaatactttgggaacatttaggtcatggtttccaattaactctggagagtttgagtaatttagtaccagacctcaagagagaggggatgaaaacctcgttaattcatatgttggtgaacggcaaaccagcaaatttgcattaaaaatggatttttattttaaagcaaagagcagccagatcttttctgcaatagtttgggtaggagaatatctttgtatgtatgtgttcccttatgtgtaggtatttgtatgtttcaacgaccctgcatatggcaataacagaaaattaaatttgtgctctaaaatgaagaccaggattcagtgacataatcttccttgtgcctttctttcttttagtacaatgaatatatcagagaggagtgtattccaatatctgtcttcagagttacaaaaacttcttttctagaatgcaagacttgggctatacccccagctctgccacttaacttgtatacaaccttgggaacatcattacaattctctcagaatcaatctctccagccctaaaatgaaaccagcaaaagcctgtactgtatatctaaaaggttttttatttttatgaaaattagttaggcaaacttttgttaagcatccatcactctattttgagataaagccttgctggatgatctccacctcttttgatggaaagagtaaaacatgtttaagatacatttatcacttgtttggcaaattgagatagaagtttatgaaagcagattgatatatgttacatttgagctactgggaaggactccagatggtttatagccttaattacattgtaactctagttaaatgtttacctatctgtaccctctgttaaacttgaatatgttaaataccaaagtccatgtattattggattttctgtcaccatcatcaggcacagatcctggtacacaataggtacggaatggatgcatggatgaattattgaattagatgttggtaggcatgtggaaataagaatgaggttcagaattaaagataatctgtatcgagtgtaaagccattggcagagaatgaaatatccagctgagtatacatagaaaaagaaggtaggtagaaaaatggaaaatatcttatgaagtgatgatagaataactctgaatatgtttgaaaacatataaagagttatgtggatgttagctttaaaaattatcttccatgctgtacattagatctgccattcttcatgctgtggatgaaaagcaagcatcagaagttaaattaaaatgatgtcatatattcctcgccttacagtttcataacagaggagaaaagagaaacattctctcattgccaccacccttctccagtcatatttctaggtagatgttgcccaaaaacagataaaaccacagagttggttttgctaggaatggactactaatccaggcaatgttgacagcttttgcttctcattagtgcacgttactaatagaattgctagagattaaaaggaatcctttctacaaagtgctgtatatccataggtgacaaaattctagcttcccctcacaagtacaatataaagttatgttttaaaatcaaaatgcaatttactagcaaactagtaggaactgttatggttacaggaaatttgaatttcagattaactctggttctatgagtagcggttgatatggcaagaatcattttgatcttacatccaggtgctactaaggtctctctgacctatatctcaccaaaaaaaggaacaaaataatgatcctttaatctttctcctaaaatatcataggaaatgatagtggctaaattgcaaataaactaggaaggaaagattcagagtattttatgtgattactctataacaatgccaggccatagtgaaagtgttatttagcagaagactgagttctttgaatgttcctaatttatcacattttaaaaataacctgggcaaaataacctttcatatcagattgagcctttttctaaaaatactcaatatgtttctgtaattatacctacacacttacaattccacagtataatgcaccgataaagtatttttcatccatatatctaatagtagaatggtgtgtatacaataattaagctctttaggcttaccccggaaagcaacaagtttcccttcctttttcctttttatgtattatgttggccataagaaattgatgatattcaactcaatgcagtcttagagatttattcagaaataccatggtgtgtgtgtgtggcgggagtagggttctaatgacaggtcagaacttacttatttgatttcttcattgataatcaggtcttaaaaagaaaatgggtatgctgaaaacatgccttctgtgattctttaccttcatgtgcagttgtctctggataaacactttctttggcacgtatagggttgcactaagctttatagctccaacactccgccccttcagtagattcttgcttgtaactgatgataatgcaaacctgtattatctataggtctccttaaagggcaaccaaaagttcagtagcaattcaggcacaattactgcatgtgagaatcctccatcttgttccctttggagaccacatatatttcttaggcaagtatatttttaaaatccttgttcagcatgacaattcaggaggtcaagttctcccagaaagcagattctgagaaagtgattagcatgaaggaattttattggagagtgctctcaggattaacacctgtgagcggaggaaaggaaagggagcaggattgggcagaaggagaagctgggctaccatacagtcacaactacaacacaatcaaccctccgcctctccttcctagccttccccaggaggatctctgaagtctgaaggtagaatagcccttcagaattgtcctgagttgcagcaagggacccaggattttataccccacaactctcccatcaaccaatacgtgcagcccgtctcggggacatagtgggtaactttgggctaggcacctctctttagctgagtccagctctcagacaggaataacagctgaggactgtcagccagtagcactaccagcagctggggtcagaagtatttcagtcctgaaaaggggtccgggcagcccagcttagcatctactatgccagtcgttctcaaatctggttcctggcaactgtgattctcaagctttagcatatattggaaggcttgttaaaacacagcttgccggattttacccacagagtctctgattcagtagagctaggctgaggcctgggaatttgcatttctaataacttctcagacgttgctggtgctgctggtccatggactatgagaacactgtttcatgctgcccttatttacatactgagaatggtacacagtgctcttatgaatagaatgaaaaccttttgaaatcacattattccttactccatcaaattctcagctatttttgtgcaccataaagctggaatagctgattataaaactttgttatgtaaaaaagtacttaaccaatacagtagattctgtttgcaaagcattattacagtttctaatatctggtcattgttacttgtaaaattcagccaaattttctccagggcctgtagtttgataacttggacaaaggaatttaaaaaaaaatctaattcaagacctttggttttttttctgaacatatcttttttttctttatgattcttatttttacattttacttatcatataagccacttaaacccatatggttccggaaaatttaaaactatatgatacatttagagcatgttgaatgcacagatatggaaattaagtattcttgactcattctagactagacctggcacaattaaaatttagggattcaacgtacacacacatagattccgagagaaatgttgaagccgtaaaacccccacacaagcaggaaacaacagtcttacctattattcaagaggcacgtaaaggagctcatttgaggagattttctgctgttattgccatcgaatttttaacgtattttccaaattagaaaatattcagcctgatgttgtcaatatttcagaccacaagggtatcatttaggaaaatggtttcttactgtcctgaaagagttactgttcttccctaagggcctaatttacaaagcagcaaacttgctggtaggatttggctgaaaatcacattgtctcggtagaactctttcatctgatttatgtgcattgcattttgcaaataactcttggaaagttatttactagttactttctctggaagcagagggtaagcggcatttctagtttaaggatagaggagctaagatgcatcaagcgcagctcatcatgaagctgatgctgataaaatgcacaatattacattctctaagtttcactctgccatgggagaatttcatatttttaaattttgtttgaaattggactacattagaaaatatgtcaaatgtctaaccctgcatttatattctggaatgtgacagcttatttctgttccaaattttgcactggagatggagtaagtcttaatgcaaactgcatgaaactgccacttttataggtcacacccagtcaattgtcagcagttacacatggttcaaactgtaaggtgtatgcccaattgtagcattgagattcgtggagttgttgcagtggttctgaatttttcaagcatgatacataaaaagataaatgactcttttgatatttctccttgcattgatagtttgcctgaaaactagataagcagggagccggcagtccacgttagcccttgaactacatgaggtttaatttatttgcccaaccagaaccctacactacctttcagctgtgcagtattaaagtttatttaggagttgataaatagcttagtgcaatgcttccttttttccagtagctacatcctcataaacctattctaccctccaccagttaatgcagacagaagatttttatccagtatgagcactgaaactccactgtggaagactgtgtgctcagcaaaaacctcacccatgatgaataaacagctcttccgggggctttgctgccgctggctcggcaggagttgtttattgcctggtttgcacatcccatgataaagttgctgctgaaataaattgcagttttgcataattattgacaatcacatcttaacaagcaatgtgtatcatattcaagtgttcaattttttaaaatccatttttagcttatgtttaatcccagaaagtgtttgtgtagtaatagaaggcaaataagacatttaaatagagtactaatttcctcattgcagacaaagtttacctgaatctttttccataggactgttactgcctaaggcaattttcctttctaagctattattatatagatatttgctgagggcatatgtgtgtgtatccacaatacatgcattttatatatatatatatatatatatatatgatcaaaaatatgaatacatttttagagtttttgtcatgaaagagtttgtttcatctttttaaaatattacaggaatggggaaatgggatatgggtagaaggaactaatgtttttgagtaactgtaatgtataactgtataacgtggggcactcaacttcacaggaattttttattttaattctcatcacagcaatagatattgcagatgagaaactgagaatcagagagggaacttgccatatcacgtaagtggtaaagaacactgggaattgaactcagatctgcctagtttttaaaactctactctttttcattacacataacatttttattttggaaaatgttctcagttgtatgatcaagtagttaaatatgaaactaacacaataattataactgatgtcatgcaaaatgatagtttgcacaaaatgatagtttctatgaaatgttatttctttacttgttaagtctttcttcctttgccctccaatccccttctttttgtcttttcctctagtcttttccttttgattctaggtttgtattttcttgacttttctccttgcatatcaaatccttgttttctgcctcagagcagcatcaaagacaagcatggtacagggattttagggttttaactataaaggtttgtctcaaatttggcagtatattaaaaataagctttcaaaattgaccaacaaaaactacaaaattgaaaaaaaggtactttgaactttcacatgttcaaatatatgtatatatatttcacatatatatatgaaacctcctctgtggagaggggtttatagaaatctgtaattgtcattcttgcatgccttcccccatacaaacgcctttaagttaaataaaaatgaaagtaaatagactgcacaatattatagttgttgcttaaaggaagagctgtagcaacaactcaccccattgttggtatattacaatttagttcctccatctttctctttttatggagttcactaggtgcaccattctgatatttaataattgcatctgaacatttggtcctttgcagggtgagtgagcgagaggctgctttggaagaaactcatagattactgcaacagttccccctggacctggaaaagtttcttgcctggcttacagaagctgaaacaactgccaatgtcctacaggatgctacccgtaaggaaaggctcctagaagactccaagggagtaaaagagctgatgaaacaatggcaagtaagtcaggcatttccgctttagcactcttgtggatccaattgaacaattctcagcatttgtacttgtaactgacaagccagggacaaaacaaaatagttgcttttatacagcctgatgtatttcggtatttggacaaggaggagagaggcagagggagaaggaaacatcatttataattccacttaacaccctcgtcttagaaaaagtacatgctctgaccaggaaaacatttgcatataaaaccagagcttcggtcaaggagaaactttgctcagagaaataacttagggattggtttattaaattttaaaagttgacatttttgagtgtttatttaatattttacagggaaagcatctgtatgaattgtctgttttatttagcgttgctaactgaatcagtttcccttcattactttcaaatatgttttgaaatgttaatctggcattttgtagctttcttcctaacatgatctgtgaaaataagaatgagatggctgaatttgtcgtagttaatgatcaaacaattttcagacaattgtttttcctagaaacaaaaattatttccataaagttccatatgcataaacagtgaaaacagaacgtggggtagttttgtttaaatgaagtcttggtgagaatcatattctgtagtacaaggaggctcttaaagtttattctcaatacctgatataattttcctgaactattatggagttttgttatgtatagttggtttttctgacttgatataataactttactagtctctcaaatacaatttggatataaatcattataataagatgattgattttttagactaactttattttttgatatttttaaactattatgaaaaactattatgaaactattatgatatttttaaactattatgaaaagtatattctagtttgaataattccagaatcaaatcataataagcagaagttcttctcctctccctcctatcgttctccttctcctgtttttcttttttgatatgatagttgatctactttgctgctctgttgcatagagtacgtaacagtggcaatgtatggctcctgaatttatcgttcttgcttcatcatcctgctttgaccccactttctcctccaaaatgcgtgttgagttagtttgatcatttggaggtaatttgtttggaacagtatcagactttatagatatctcccatggcttgtgatagaatataagggcaatgcaaatgtagagttttttgctcactcttcgatgtatggttagacaatgtaccactgtaatatatttggcttaggctatttcataaataaaattttattataaaatattataaatgctgataaagctactccagaattttaatagatatgtgggtttcccggccagatgcggtggctcatgcctgtaaccccagcactttgggaggccgaggtgggtggatcacctgaagtcaggagttcgagaccagcctggccaacatggcgaaaccccatctctactaaaaatacaaaaattagctgggtatggtgacctgcgcctgtaatcctagctacttgggaggctgaggtgggagaatcgcttgaacccaggaggcagaggttgcagtgagccgaggtggcgccactgcactccagcctgggtgacaaagtgagacttcatctcaaaacaaataaataaataaataaaaatacatgggtttacattttacccatcagctatggtaggtaaataataagctttgattaagtctattttagtctatttttagcagattactttgaaaaataaagaataacccaatgactaaaaaattattttatgtcagggatttaataaaacatatctttaaatctagttgagggcaaaaatacgtctattttctactatacaatttgtatttatatctgctgtattatataatgaaaatttatctctatttctaatctcaagaaactgcaagcttctgaatcattaaagggaagattcaccatgtgtcctaactatatttactatggaagcatggaaaataaatattttatgtttagatttctgatctctctttcaaaagcagttggaaattatgctgagaaaatgtcttagcttatcccatgttactcaagaaaatgtatttattcgtttttgtccagtggcttaaccaaaccacagtttatttgttgctcacataaagtccagtgtcgatcaggctactcttttccatctttgagctaaggcacatattacacataactttcagtgtacccgaggtagaaaaagagagagcttgggaataaggcaggggctttttactgtctcaaccccaaagtgataaactacatttattctcaaaatccagataaaactcccatagagcctctgaaaacctcaacatttgcgtcttaactataataaggttaactaagattccaaaattattttaaaacagagacagtttccctcttccctggcagctaatattgtattttctataaatccacttgcccaaggtttaaactacattttatggattgaaatgacatttatagccaactcctgatttttagttagatggttggataatgatcttttgatgaaagactcggagatgtcatggtaaaacggtgaactactgaaactattgattattgttaatggcacatttcagctgattgaattgagtcaagaaactggtgttgaagagcaacaaatggaaatgccgagcttgaaaataaataaagcagcataccttaagagattacatgcaatttcagtatttcagctaaatggaagtgtttgctttttttcctctatgaatttttattttgaacaaaaggaattttctataatatgtaggtaggagaaaagtgaaatggcatgctttttcacttcatttgaagaagctggtagcattgtattcatagattcatgctgtatagcaatcatagttctcatatattaaaaaaaaaggaaatttgaaatgcctagccaaagcaacagctctgccaacagattttgatatatctgtctaccccaaaagtagtgatgatttacttcatacaaatgctagtgaatgaagagagagggtgaaaaccttcacaaaatgtgtttttctctaagactgtcaatccgtttttctatatatggagactccagctcttgctagactacctatcactttcgtctatcagccacttcgtaagatatttattctctcagcaataatcataattcatagattctttaaacatacatgtaatataaagcatatacattctgaatggaattaacatgattaattcttctctgaaagacattagaatttcctcccgtattataaaaaggtgtaactcactttccttactaaaatcaagaactttaccgtcgtccttgtacttcaggataagggggtgtttcttataaatattgttatttctgatatgctaactggaatttttaagcaaatgtatttttatagaacgccatacaaagcctttaggggtgaaagtttcaggatttttaaattgcagatttatcctttaaataaaaaaactatattcgtaattgaatcggattatttctctatccaaaacattttctgctttgggcctaagaagagttgacaaagctgttcatggttcaaagtactaccataaaaccctgggtaactaactgaaaatggaaagactctgtctttctgaatatttcacaagagtttcacaaatattaagtggttctctaagtacccctgagagatcattgtaatattagcttgtaaagacaatgtgggggtgtgggtatgtggtgacctttatgatgttcataaaggtggtgtaattaacatatttttctcagcaagacaaactaaggagcaataaatatatgagataccttcatctgtgatctgggtcatgtctcaggccatatctttcaaatcactcccttccctaatctcgtgttttacctacgtctcctctcaatccccccattataaaaattgtcttctgatgaataaaacatttccagagagacaagtttcataaagtttgaattgtacatctgagtacacctatgaattaagatatctttgatttctaatatgttattaaaattgggtgtggtggctcacgcctgtaatcccagcactttgggaggcagaggcgggcggatcacgaggtcaagagatcgagaccatcctggccacaaggtgaaacccccgtctctactaaaaatacaaaaattagccgggtgtggtggagtacgcctgtagtcccagctactcaggaggctgaggcaggagaattgcttgaacccaggaggtggaggttgcagtgagccgagatggcgccactgcactccagcctggtgaaagagcagactctgtctcaaaaaaataaattaaaataaaataaaataaaattggagaagtttctcaccaaaattttggcgcacggattaattctgaagaaagaagaaagaatgcaatcttagtagcacaattagtaccttgaataaattggagtatcgtatttcttggactatctgagaatgcagaggcaatttaaggatccctaattctaaggagaagaaacctttagtgtattccttcctgttgctttagtttgaattgagttttatatgtattttttaatctttctattttgattgttgtctaaagagtgtgaaagtgaattttgatatttttattttgcctggcgatgaatgccttctgctctggatatttaaaaattatatacacatatatgtgtgtgtgtgtgtgtgtgtgtgtgtgtatatatatatatatatatatatatatatataaaatttttctgagaacttttattaattcagcgtatctttgctaaacacctgccatgtgtcgtggtgttaggtctggtgatacaaacatgttcagagagatgattttctttcttttttggggggtgggtaagggaaagaaggcttatacaacagaatcttatttctcacagttctggaggctgggattccaagatcagggcctggtgagggcccctcttcctggtttgcagatggcttccttctctctgtgtcctaacatagcaaagagagacagagctctgatgacacttcctcttgttataagggaactaattccatcataagggccccaagaaaggtgcttttcaaaaacagttcagtaaaagtactgggttgtataatcactttaatgagtatcaatccatatttttaagatagaaatgaatgaaattagtaaaatagaatagaaataaggagtccatcacttttaagtaagtttcaatattgttcgtaaaactttggttcggtggtttgtgtgtgtgtgtatttgtgtgtgtgtgtgtgtgtgtctgtcggtgtggaaatactggatcactttgtaacatatattcaaaagcctctgtattttaacattatttctgcctttgagaggttcacattccagaggtgaagacatacatcctaagacaaaattataatagcattatgagaattacagtagagagctggacagggtctagcaaaaacagaagactaggctaaaccttccaaagaggccaggaaactcacctagaacggtggattttaaccttgcttatgcactgggggagattttaaaaatatctctgcccacaatagataccaactgaattgagcatagcatgtcctacccatgaatctattgtccagtgagaacctctgtttagagaaagtcaccttagaagaattgttaggagttatttaggttcatggggttgaaaagagcattcgtgatagaggaaacaccatatccaaaggcttagtcagtgtggtagtgtgagaatctgaaggaacttggctggggtatggttgctacaagaaatgaaattagatcaactggggctaaattatgtggaaagacagcatgatgtagcagctagagtatggaccttgtaagcaggaagaccccttatttagcacttactagcttattgtctgacctctgagtcccaattttactcttctatacaatgagtacatcacaggattttatcaggtttaaatgataagatatatgtaaaatgcataccagagaggcagactattggactcgaagggctcagtaagtgtaagctggctctctctgccccttgccacctatttttcagactctggacttttatcactttaagtcatagcctagttctaagcaaggaaatggactaatcagacatgtttttaaaagatcattctggtagtggttaggagaatgaattggaaagatatgagacccatgcagggacaacagttaggacattatttctgtaataagccaagcaagaattgatgatcaaagtggtgaggttgaacaaacaaaacagatacgtgagctatttggagataaaatcaacactgtcatatgttttgtgggaggtggaggtgagcagaaaatgtgaggtaaaatgagaaatcagtgcctgcttaccacttggcatgattgactgaaggtagtgtcttcactcaatcatgagttgcagaattcaagatggcaaacagttgtgaggagcaaagtcaagaacgtgtttgattttgaggtatctgtaagtgaaaaatcagaggtgaaaaccttacctctcttgaagcagttgtgaatgtaaatctaaggtttggaaaaagatctgggttaaagatttaaaattgaaggacatcaacatggaagccatagaaataaattatattacacacaaatttatgtcgttatttgaatttctccatggtccactcagaaatatatctaaatgtcaccaaaatgttacttactgtagtacagaattggtattaagtgatactattgtccatgttattcaaaaagacagttatagggaccctcttaataaactaattgtgaaaaaggcaaagaattagcaaagctttggcataaaattcatatcatgggccaggcgtggtggctcatgcatataatcccagcactttgggaggctgaggtgggcagatcacctgaggtcgggagttcgagaccagcctgaccaacatggcgaaaccccgtctctactaaaaatacaaaaattagccaggtgtggtggcacacgcctgtaatcccaactactcgggaggcagaggcaggagaatcgcttgaacgtaggaggcagaggatgcagtgagctgagatcgtgccattgcactccagcctgggtgacacagtgagactccatctcaaaaaaaaaaaaaaaaaattatgtcatggaaaaagtaaaagtctttgcataatgtatccaagatcatgaaaaactcttttcaataagataattagttccttttcttatataaacatggaaattttcatttttccttttattctcatattgatactataaaaaccccatcctcattcacaatactactgtctctaccctcgatagataccagttcaattgaacgtagcatgttctacccatgaatctattgttcagtgagaacctctgactataatgctcaggaatactcaagactcacatgattgtcttcttgctatatttagttactttattattttccattttgggaccctgaattcctgtagatctcagagaaaatccgaaatgaaataatgaaaataattaaaagtttagaaaagggagtcaatggggacaaatgttcaggactggtcttttatctcctgcaggaagaaagactgaatgcagaaaattagaatccatttttcatccagtcaccccaatttaatgcaatatgagtttagctatttgattttaagtgttgtaccgttttggaccatgttaccatggtaacatgaaccatgtctcattcatacgtaaacatgttaattgtattaaaacctttaaaacctacttctggatgttgccattacattaaacaattatctagaatgatacaaagtaatgactaaattgaataactttgtaaattaactattggattttgtaattttatatctataaaccaaaagaaaagcccacattggtaagaagacactgtgcatactgaaaagtcaattttgttagcctccaataaccattgtgttttattcctcgcagagcttttgtgaggatcttataagggaataaatatgaaagcactttgaaaaagctttcaagtgaaaggtccttattaattttatgaattaccattaaacaaaagtcaaactgaagatgtaaatctaataggatgctcttaaaagtcaatggatcaaagttatattaattaataaagaataataactaaatattttatgtttcataattggcaaagtatctttactgtcattttctaatttgatccttagtgaaaacctgtgatgttggtactcctattatttccattttcatttgagaagaataaaattggagaggttaagtaatttatctattgctacttgttaaaataactactaaattttattactcccagttaggagggcaattatataaactaaaagcttgtcacaataaatgtttacttttctgggattaaagtcatcatgtatttttcaattattaaggggggtaataataataatagctacctttttaaaatagttactatgtgccaaggtgtgtactaagtgctttgcttgcatgatgtaataccatcgtatatttagtacagaggaaaaactgagaggctgggtaacttctactaaggtaacacacaagtactggttgagtatcccttatccaaaacacttgggaccacaagtgttatggatatcaatttttttctgattctttttttggatttcagattttttcagattttggattacttgctttataattatgggttaagcatcccaaaccccaaaattcaaaattggaaatactccaatgagcatttactttgagaatcatgtcggcgctcaaaaattttcagcttttagagttttttggattttggattttcagatttgggatgctcaacccgaatatatagaaaagtcagcatttgaacctaagtttgactttctgatcttctaccaactctactgtcctacccattactctacattgactcagcattacagggaaagacccaagatcaccaaaagcaagcttcaaatcactcatctaatagaaattagtggaaatatttctacttcctaaacatccatctttcctttacattttaaagtcaagtttctacatctgcctcccaactgaaacacttctctatgaaatcaccataactaccaaatgcaaatatttttatcaagtcctcattgccctagaaatctactcatattttgttattactgctcactacagcctactgaaaaatgtctcaccttttgacttgccagggtgatatattatactaattgtctccttgtctctctaagcactcattccttcctctttctttcttctttttttttttttcacttttattttaagctctaggggcacatgtgcaggtttgttacatgggtaaattgcatgtcatgggagtttggtgaacagattattttgtcacccagataataagcatggtacctgataggtagtttctcagtcttcaccatcctcccaccctccaccctagagtagatcctggtttctgttgttcccttctttgtgttcatatgtactcagtgtttagctccacttataagtgagaatatatggtatttggttttctgttcctatgttatttcacctaggataatggcctccagctccatccatgttgctgcaaagaacataatctcattcttttttctggctgcacagtattccctggtgtatatgtaccacattttctatatctgatctaccattgatgggcatttaggttgattccatgtctttggtattgggaatagtgcagcaatgaacatacagctgcatgtgtctttatggtagaatgatttatattcctttgggtatatacccagtaatggcattgctgggttgaacggtagttcagttttgagttcttagaggtatttccaaactgctttccacagtggctgaactaatttacattcccaccaacagggtataagcattcccctttcttcacaacctcaccagcatctggtattttttgactttttttttttttttttttttttttttgagacgaagtctcgctcttgtcccccaggctggagtgcaatggcgcaatcttggctcactgcaacctccacctcccgggttcaagtgattctcctgcctcagcctcccaagtagctgggattagaggcgccttccaccatgcctggctaattttttatttttagtacagacagggtttcaccaggttggccaggctggtcgcaaactcctgacctcaggtgatgcgcccgccccggcctcccaaaacgctgagattacaggtgtgagccaccacaccaagcccacagtatcaattctatgcattcttttctgatttcattaatctcattatcttcatttgatatttagtcaatagttactgtcagttatgtgttagttattatactagaaacagtcttttctccatctcctttaatccaatgatttgaacatttttattcctttccaatgtctgtcccacatttcttactgtatgtaggacatttcttactcaaatgtctcacaaatgacataaattcagtatgacccaaataggccattttttataccaagtcttatttcctatcctgctgttcatcccggtaccatcttttcagtcagagagttcagatcatatagtcatttctaaatctcccacttacttgcctcactttcaagttcatttttaaggtctgtagattctgcctccctaattctttatgaccattcctttctcactagccccttacctccactctcattcacactcttactattttttaccctcctccactcattcctgcccaccagtggctccaatccaacttgcagatttccatttaaattaagcttcctaaaacatagcttaggttgtaactacaatgcaaattccatgagagcaaagatttcatctgctttattcacttgtatatatccattgtccaagactgtgtgtgtcacatgaaaagtgttcaataagtatttgtcagtgaacgaaaataatatatgactcccctcttcaaacaccttttttgacttcaaagcccttcagaatattctacagactccttcacctggctctccacaattgcccctgagtctcgtttccaatcttatttcttattttacctctcaatgcaccttcaactcctactaaaatgaacagctagccagcttacttctgtgtctttcgatgatcttgttttttgtcttgagattcctttttttcatctaagcttacccaaacattacctacttttcaaggaaagccattttcgaatcttccctttttccctgagcccccaagctggaagacatcttgtctccatctcaattcctataggcatttctctgcactttaaatgacgtttagtacttctgacattgcattagagagaggctggggtggatagtgtttcatagtgtgaactttgaagcccgactgcctgagtttaaatcgtgattctggggcttactgaccatagacgcatttctgaattgctctcagattatggagcataaatcaaaagtaatgacagctacctcttcaggttgttgtgagggtgatgcgaattaatgtactgaagtgcatggaacagtttctggcacacggtaagcacccaataaacatagctaatattatgttattactattttcaggcttatttttatgtatacatatagtatgtaattttatgtcaatatgtataaatagactttggtattgtttatttcactatcaccttgagagcacaattctcatttgatttgtgtgagaaactacttagaaagaaatagacgtgtgaatgaaactatgcttgaaatattggttactgtgagtgttgaaaatccattttgtttaaagaaagcttcaattgttaatcttccataaattttagttcttaagcgttcatattgactcgttttggaaaagctctttaaagtcttgggatataaacaaggctgaataccctcattcatgataacaaacatattatactgaaaattgtaagagagatattttatctttcataatgccctccttgggaaaatacattgacttggcccttctctttcaatcagacaccaaagttgagattgcctgaaacacagtttggtaaaaggagtttctttttcccaaacatcctgagtaacacaggaaatcacaccaatgactgatagataacgttaataaaattaataaagttgttttaaatgcataccatggggcagtggcaatgaaaacattgagaaggctgggactatttgccaactttctttgatctccattagaacctggacaagatccacataatttcagaacttcttctccaaacaagaattgaaaaggtcaggaaaagtttgaccacagaaaaatgtcaaagaattttgtgtcactttctcctcctcccttcctctaaccttgaataattttttagggttattggtctttgggagcagactttctagaccaaaacaaaaaaaatgatattcctctatgtgataggtaacaatcactacccatcctactggaaaattctcaaagtgtaaattgaggggataaaaaaagaatcttaagtcctttaaattatttttaagatgaactacattagtgcctctcttgtgcctttcataattctgataataaaacattccaggtattagtcaaagattaatggtattgaaaataatttaggttatcagcatgtgattttcattccacatgaggtccttttgcagtttacatggttttctaaattatattaaaataaaatgtcagaaagttcacatttttttcatgtttaacagcatcaatctttaaagaaaagttattgcacaaaggtctgtgcataaatcagccattctccgaagaggtaaaagaagtcattacgcctggttatgagagagagtttcatgaatgtaagagacataaatcatttcccactggagatcatattagtctagatggaagaatgtctgtttcttgatagtgagaaagcaacaaattacttttgtttgctcctgagtctgtggttgtccttgagaggtctgttagcatgttgactattgactattcaatattagcattataataacttacaatgatctgagtcacataaatataatctttcagttctctaaagattttactttttcctctctaatatctattcacctccaacacctttgcaaatatattattctctgggagttacaaagaaagttattctctgcaggaagcagcatttcagttgctctcaggagccaaccacatttcacctcaattctttgctcccaattcaacaattcaatattggattaaattcaaggctgtgaccccaaatagaatgagacctggatatttatgaaccacttgaccaggcattcttcccatgatttactccataaatcctttttagtttttgcagtagctttacaaatatttggaaaatggctgtgcaatgcagttttaaaaagtgcaatgagtagaggtagcttcttcacctggtatggtaaattgttgattctcttttggagtggaaaacaagtgttcttatttggatgcaaccattgcattgattagacaaccctaaattcatctttcatccatgacctgaaagaaattttgaaattcatgcaatatatacccgtagtggaaaatgtactttttgaatggattcctgaatgtgacttttaagaagagctattaagaagtgggatcttctacagaacagtaaacaggcatgaaaatatacaagttgataagatatggaactaccccaaaagaggaattaatagtggtggggcttggggcaggaggacagagagacctagccaaggaaggaagggctatattataatagagtacaaagtcctttagtcatccaagagaaggggcaccttctgcatcccttatgagtaagatcagagaaggtattctagttaacttttgctacataacaagccagcccaaaacttcatggcttcagtaaaaattacttgttttgttcatgaatctacagtttgctcaaggttcaatggggcttgcttatccctgtttcagttgatatcagttggggtagattgcctgatgctggaggattcacttccaagagggctcactcacatgcctggaaaataggtgctgactgtcagtttttcttcatgtggacctctccatggagcagtttgggctttttcacagtgtaagagttgggtcccaagagcaattatcctaagggacaagaaattaaagctgcaagcttctcaaggcctgccctaaaagcaagaatggttttgcttctcccatattctatttgtcaatcagtgacagagctctgattcaaggggatgagaacataaactccacctttccatggagaagtatcaaaaagttttgatgccatttaattaaagctgccatacaaagtttcttataaatgacactgagctgaatgaatactaaacagcaagtagtcattatcccagtcaagagaagttatctttgctcagaataccctttctctccttgtctacctggaaaattcaactcttggccaaagccctacctcttctcgaaagcattaccaggccttgcctctaagtgtacaattggagatacaccagtatactgatgtttttaaaactttaaacttttttctacaataaaacataaattaaataacttcccttctgacttaaaagctgcaaaatgctcatgacagtaactatataaattaaaattaaatcttaagcacgataaatacctctcgaatagcaacatagatgcttacttctttatttcacttctttatttgcttttctttgtctatagtttgccccaaaggtattttaataatatcgggttccatgtataccagtgtgtaccaattaatatttagaatatacctgttaataacctcatttgcatagccctactaatctgagcacagcgcagccttaagaaagtcttagtttttctcagtttagttcatctctcttctcttctcctcctgtctctcttatttcctatttctttttcttttcaagtgactttcaactaagtagaaaatgcatttcacatcactatgccggcctccaggctctgtctatttcattcacccaggaatgccctttctgaatgctttctctcatttagcagctatctattgaagttggacaaatgatagaaattcatttcttaaagagccagaacatcatcttgaacaagaagttaaaagaattcagcaaatcaaaagatgagctaatatgggtgaatcttagaggcattatgctaagtgaaataaaccagacacaaaatgaaaaatattgtatgattccactggtatgagctacctacaacagtcaaatttatacagacgtaaagttgaaggatgttaccaggagctggaggaagaagagaatgagggcttattgtttaatgagtacctgagtttcagtttgggatgatgaaaacattctagagatggatagtggtgatggttcaacgataataataatataatattaatgtacttaatagtactcaactgtatacttaaaaatggtcaagaaaatggtaccccgttatcctgatgtgattattacacattgtaggcctatatcaaaatatctcatgtaccccgtaaatatatgcacctactatgtacccataaaaaaaatttaaaggctaaatggccaggcattgtgggtcacttctgtaatcccagaactgtgggaggctaaagcaggaggatcacttgagctcaggagttcaagaccagcctgggcaacatggcaaggccccatctctacaaagaattcaaaaattaactgggtgtgggagctcatgcttgtagtcccagacacactggaggctgaggcaggaggattccttgaacccaggaactggaggaagcagtgaatgacactgtaccccagcatggtcaagatcccaaatcaaaaagaaatgattaaaatgatcaattttatgttgtgtatattttgccacaatacaaaaatggggaaaagcctattcgcttttaagtatccttaaaaaggcacagcttcttcagctaacagactctaaaactttttttaatagaagtattaaggtatttagagagtgcaaaatatcttattttaagtcaagaagttagggtcctgttcctaaacactagcctctgtaatcctggggaagtcagtgctgttggagatctcaggttgatcttctgaaaaatgatggatctaggtaaaagatatgtttctccaggtttacataccacggacaccatctttacttggaaactttattaaaaatgcattgtgtcagaagctctctggggatgggtcgtggaatctgcatatgtaaagagcccctaggtagttcttgtgcccacttaaatttgagaaccactagaccagatgttttgcttatggccctttcagctctgaaatttgaaaaaaaaaaaaatgattctgcaagacagagtctctgtgcttttgcaggataaagaaatgaagaaaataatacttcctgcttgtgttggagcatttttttcatttggtatccccatctccagtggctagccaatcaagaatagtattgtttattcttcccactgttttgaagatacaaaaggaaaagctaagccagatgacacctaaaggcttccattaccattttcatgtttttccctttgcataaaaactgtccatgcctccatcagagccatgatcactagtacaatgttacactctaatgactcatgacattaaattatatcttagcctaatatgaccaaattacaatatcagaataaaaatttcttttttcaggttgaatcccataacttaatccaattataatactggctgaatttttcacaattatgtctcagtcttgatttagggaatcttctctttatcataaaaatgcattttgttaaacatgtttcattataatcaatttctcaaaagtaaagttaatcaagagaaggaaaaaaggttttgttttgatttgatttggaatgtgtatgtgtgtttactgtattgaaatagattctgtctgaaagactgtatataagataaaaagtacagaagagtagtcagagagttattacccacccctgactgatggtgaatagattatctaagtatcccgtaaaaggcacaactccttcaggtatattttacaaattaattagtaactttctagccaaatttgtgtcttaaagacaccagctagaacttggttagttctagcaaagaagattattttattctgaaacaggtttttgttgtcgttttacttatttgaacttttttcttgaatatgtatttctttgcacataaaatatattgacttatgaatgtgattaaaatggaaaataattagttgattttagagagacagagagaggagaagagaagtgtgaaggagagagggaggatagaaaggagagagggagaacaggaaggacagagggagaatgggaaggagagggagagagagagacagagagagaggaatggagtgggtaataagcaagagaaaaatgccaatcatatgctttgctagtgtgtaaagtctgataacccaagggagagaggactactctggcctagtgaaacaaaggaaagagaaatatggtagaatattctcctggtgcttcaccaaatgtgacaccagaagtctgacagaagtcatgtcagcatttgagctccataaaactcaggctatcgacctaccatgtgagagtctcaaaatgagtttaggtaggggcagaggagttgaaatccagtaacatatgcaacagtgatcacaccaggattgcacatagaaagcaaattagtcctctaatagagacgccaatttgaaattcaccctctgagcaggtttttaagcacactcttcttttacttttctatttacaaaaatggaacaccaccagaaaaacaagaatttgaaagacgagatgagaaaagtaagttgtaattggaaacagacagaatgtgtacacaaacacacacacacacgcacacacacgtgcatgcacaggtgatgagagagtagtttgcctacatggtgtatctgactaagaagactttttgctctggttgtcttacaggaagtgactaaatctcatgatgtgaaatattttcttgcatattgtattggaaaagaaaataattttcccaaactccttaggggcagtgttgtcttataattcccatatagtatatgctcttcaagtaagtaactccagagttgagtaagacaagactcgtgactcagatggcatgctctgctccctagactagacattgcatcagtctgcctatactcacatccgctgttaaaggattgcctccagtaaaatatgtcttttaattccttatacaagaatctggaaaaaaaaagtaagattctctatttcttaaatttagcagcaggttaatcactgataacaataaaaatacataacaatcatctagcacgggtaaatattgtggcaaaaattacaccctgaagaattcagtcaaagatataagtaagtacacatcattgtcatgttccacaatatatcatctgctttaaagaaactgttatgtagctgtagtagatttaatcattaatcccatttcttctccaccttctgcaatcacaaccttaacaatgcctccttatgagtggaatgtacttcccaacccctagtcttaggggttggccatgtgatttgctttagcaaatggtaaatgagcaggagtgagaggtgacagttttcagcctaggccttaagagatctatacattcctgtttgtgcttctgctatcattctgagaacacgtccatctaggctgctggtctcaggaaaacgataaaagacatgaacagcagggctgcactagccattcacatccaggaaaagaaatgattgttgcataaagccattgagctttattctacattactgtgacaatagctaattgaaatagtaaatatactttggtttttcctaaatgcatattgaaaattaataatattagccatctgtatgataaaaatataaagcctatgttttattttttaatggttcactgccctaaataaatttccaaaaagtagatgttcccttgtctagtgatgtcattatattttatttatacatcataaacacactgtttatttctgctcatttttttgtaagtaacatgtgttaccgccaatcttgagatgatacacacacttctgtactaaattttggaaaacatattagctacccactccttatatcaaaatattgcctaataatgtgttttgttttaatccttcatgaatttccaggagaactgaactgatacttgggtttgtgagatatatgaaaatagtgaacatgaacttctggtttaacccttgtgatgataatggaatcatagctctgttaattactcttgtggtttgtcttcctagagataatcatgtacaaaattcctttccaatttgttatataatattagaaatacttccaaaattggcatggatttattgttatcatttgttggcacaatcattaaaacgaaacccataaagctagataattaaatgtttacaaagctatagtactcaaaacaaaaacactgtgaaaagagattttttaaataatagtttttgcatgccttttgaataattggattattctgaatttcttcatgtttagtccctgaatctaagtcataccgtctacataaaaatagatgtcagctgaagaaaaccaggcaatggatttgtcttgacgacaatctttttatatgttcagacttcatttaacattagacttgtctgtatttgaaattggtatttctttacatttctgaatttagggaaatggcacaagagaataacattaatttcctctgcattttggcctaatcaaatttgagcctttcaagagacacagccaagtcaattcaaagagacatatgaaaagactactgttaatgtatctttaaaatgaattagcggcatgaactgttgctaggtgagttaggtatagttgtagtttttagtaaccctaagagaagatgcagtgcattctaaaatgtcacaaggagtttgattgctcaaaattctgggagattggctctctgcaaggcttcttgatgtcattgttcctagaggaatgttgttccagtacctatagcgattgcagccataactatttatgtgtcattgtagccattgttattactacatgcttcacatacctctactgaggtctaaagaattagtggacttcatattctggagagaacacttgaagaaccaaacagaagtttgatgtgaatctgcatatccaccattattgttcataggttctcaggattagttgagtgatgccttaaagaaagaaagtcagatgataggtcttcctgctgcccgcaccacatcatgagtgttattcctatagaggaggagtaaagagtgggaagaaaatgaaatctgtcaatactgtgaatatataaataataaaagtagcagtaggactgattaattctgaatcatctttatgaaatgactggagccgtgaaaatgctcagtctgcacagctgattgagaaatgtatgcaatctgttgatcggaatttatttgtgaatgctctcttccagagatttatataccagagttcttaaaacgaattttgtccccatgaaaagaaaactacagatctgtaagactgcaatttaaaatggaagaaaacatgttcccacttgaagaacaactttcaaacaaacaactgatacaaaaaagtcaaaagctgttttgttttatataatagtttcagaatacttccagtcaatatataccttggtttggtgaaaaaataaaaagctaaatccttagatcattaactagaaatttttgtaaaataaataaaagccgtgggttttagtgcagtgatcccatgaagaggaatatattcaccattggtctcttaatctcagatagaatgtacatgttactttattttataacgaaagcaactgtgttgtgatattatgtataatattataacaggagaagtcctcttagctaactcagtaatcaataacattgtacgttgtgtgttattgtaaccaaaaactatgacagaaccccatttcataagatcagtttatccacctatatgatttatatttgaatattcatttcagtacttatgttgcttaaacaaagctactgtattagtccattttcatactgctataaagaactgcccgagactgggtaatttctaaaggaaagaggtttaattgactcacagttccacatggctgggtaggcctcaggaaacttacaatcatggcagaaggtgaaggggaagcaagcatcttcttcacaaggccgcaggaaggagaagcgcccagcgaagtaggaagagccccttataaaaccatcagatcccgctatcatgagaacagcatgggagaaactgcccttatgattccattacctccacctggtctctcccttgacacgtggggattatggaggttatggggattacaatttaagatgagattgtggggtggggacacagccaagccataccaaaaactctgttttttgtttttgtttaatggaaatgatttagaactttattttctgatgtttctttttcataaaaccacgacaccaaaatctacttttcactgctccattcaactagtagagaatatctaatctcttctcaagtatttctttctcaattatggtggttttagctaagaacagcttatggcatgcttttctaaataatattagaacacataaattatctgtacctggtattaccacattcattgctcattttaagatctcaattgatacattcaattcatatatatttaaaattgattcatttagagcaagagatacaggcattttaatgtattacactgctactaaagcttagcaaattattcttttttgtgcccacaaattatcatccattcatgtcctaaaaataaaattgaatttattatactttcccatttatccaaaaaaaaggttttttttaacaattgatgcagatacacattttcaagctaaaaatatgtgtgaaagtggcctctttctcatagtatttattttaggagtctagcaataatttttcttaggttatcagcacatgtcttagcctgaattatttgaattcagtctgtgtcttcaagttcagatggttatgtgatcttgttaagatctcaaagtagtgggaatgatggagtatacaacaacctcattgttttttatggcaactgtcatttactgaaggacataaggctagcagaacatggtcagagaaggaatcaaagtttggtcagccaactctgctccacagctacaagctgctagacaggcataaatttttccaaacctacacaaagggacttagggcccttggctgagagcgacattctaaccacttccttatttatggctggtggggtttgtacattttctcatttctgtataacatttcttgactgtaataagcaatgtattcattctgctttaccactttcactaaccttaacctcaatatatactcaattaagcaattgaaaacagcagttttaatcttttgacataaatgatttcctccgaagcaaaatgctggaaatcccctcaaatgcaccttttattgatgaatacctataagcaccacctacagtcgctggaggctgacaggaaccaaacttgatgataaccactgagctgagaattttcaactcactctttttccctgtatggttcttctagctgcattatttcccactatttaaagctacagctggtgaactattcaaatatttaaactttggagaagaaaatatcaacttatcacaaccctctttttatattctaaattcatatacctgtttggtacttaaaggaaaaatatgctgaggaacaggctggtcataagactgtatagaacgtgcatcttccatcctattgaggtgactcctagacaatgggaaaaatgccttcactcgacttgctcattaaatgtgaccgtagctgctaatcttttggcgctgtctcgaactttaattagatgtgctcttctcttgaaggttggaactacagtatccagagaccatagaatcacagagttgaaaacaaaatcttggaaatcattgaatccacttatcagatgagaaaaaaaaaataagcccatggagatagccattttaaaacatatcattctatttagcctccaatgtaaaacaatgagttactatgtttcaataatgttgatgttaagaaattatttgatagcttcctcacttggtctcctatattcctccaaggttactagttaggaagactgtcattcaaatttggagactacataagaagcagaaaaagcatataaagaggcacatgaaattggaacttttctggtaaaatcttctttcttaaactctcctcaaataagctgttggtggcaggaggtgaaagacagcctccaccctttagcacagtccgtacttgtcagcatttcccaggaagggtgatgtctggaaatgatagagattgtggaagcacattgcattatgggtcaagaatgcgaaggtcaaggagtggagtcttcctttacgaagtagtgttaactgcttggcgtggcattgttgtaaacagaagccaccaggaaggatcatccttaggagggaacctgtagatatgactgaaaacaagagagatccagttttaccactctggaaacataggtaatagaaagcccaaaaggtaccttatcacttgtttgttcctttctgtacaaaaggacttaaatcctttctgagcaagaaagatatttgagaatccaattttgttttaaacttgagcttagcattttggaactattccaaagaccacagaattcacagtcattagcataccacagcagactcttttcaaatattgcaaaccagaacagtctgcttgaaaacctggaaatacgacctagtgggttcaacttgactttttttatttctaacccttacccctaggcaattattgataactcattctggtacctggtatgtatatggactttgttagaagaatttgacaactttctaatcatctgttttttttcttttgcttgatagacatacatttagtagaactttactggattgtattgattataaaccacatttcagttcatatcagtccattttgctgcacaataaacaaccaaaaaaatttaattcagtggctaataacaacaatattgatttattcatggagctgcagtttggtagggtttggccaatcatggctggaaatggtttagctatgcttatctctaggccgtcggttctgttcgggtctataccacatattttcttctgagactcaagctgaagggacatcagctactcggggtatgacagagtagcacaaggcaatgacagaagcacaaacaacacttttcaaaatctctcctcttgtcacatttgtttatagcccattagacaaaacatgtcttgtggccaagcccaaagtcaaggggtaggaaaatactttccacctatgtgaggccatggctggagcgtgaatgtatgatactactagggatgtgaaaggattgaggccaataattcaatcttctattggagacaagctcaacgagttagttaaaatggaaggctaatatttactaactttgcaacccaaggaagagaaagcaggatctctctgacgatgacggaatttcataccctcatctttgaagttatactaaagcttaggaacaaccgtcagataggactgaattgctcccccttccagattcagcatgtgaagtatgcagcatcttattatagcagtagccaaaacagccgttttcttcaatttgggaatacaatgtaggtgtgttaattttcaattaagagttctaaacttattatctgcttggtagctcttccatgtgacagtcattccatctgactcttcatgttggcttttgaactaaattttaaaggaaccgccaaaatttaagggccatgtactttttataacctgtttgtggtctgggtaagaaaataaaaattatacaactgttctttttgaccagccacaagcatgtaatgaaaatgactgttttggctagcagatgtattagaagctttcaaggtgtttaaaaaaaaaaaaaaaaactggagaaaggagccagtgaattgacctcaaacaaaacaagaacaaataaacaaaacacttgtctgcacttccaaggaagggtgatatctagaaaagatagagatgatggaagcaccttgcattatgggtcacaaacgtgaaggtcaaggggtggcgtcttcctttatgaagtagtattaactgcttggcagggcattgttgtaaaaagaatccaccagaagtgaaacaagcagcactaaaagttaaaagatttatgtgtaaacctcatctaaggcaacagaagccatttctataaaatagtataggaccttttattatatatggtcctagagtatattaaaataagtctgtttgggtccatttgcagctcatttgaagatttttataggaaaaacatcctcaaaaatatcatactacagtgccttgatgcttttttctttttataaggtactgccagcccaaatagtaagaaaccgatatgatttttgtccatgtgaggtgtttaattgcttcccaaaatatggttattgtgtagatgtcactaacgaaatatataaagagcagtatttgggaaaatttattttaataccacctttttccttttttaccctaaaagtatttatttttttcgtagcatacactctgtgtctcagtatcattgtttttcataaaaacataaattcttaacagaaaatttcctgcaagctcccctaagcttgaagagacaaaggagatttgtaatgtagctcagccccaatcagggtaaaagaatgcagggctgactttatacttataactcagaaaaaggttatgcttcccgtctcttcacagagctagtctcttaattgattccgaactaggaacatgtacaagtggcccacgatctggaacagactggcggataatggaatattgagaccttgtctatggtcagccatattaacactggataagtctgataacactgtgattacatatgtatcaatatagtatgctgttaatatattaaaaacttatttacaacatgattattggacaactgttacagtacagccacatcaatcctatatcaagttagaccatgtcaactggttttgtgttgagacacctgtgtatggacatagtctgaacttttcatagtttgtgctaaatgatagcaatcaacatcggtatggcacttacagtttactgataactttcatgcccattaacatagtaccgcaataactctgtgaagtgctgaatttgtgtcctgtttcatgattgtatttgtgttgatatctcagtcagtcagagtcccaacaagaaacagatggcacattcagattagggtaagttgaggagtctttatttacaaggcactacatactcaggattgggcagggtgtagggaaatctcacaagatagcacaagactctaggactagcagcagcagagctgtcacctctcctagacctgaagccgttgttggggagagaggtttctcagagcccagaaaaaaagaaaaaaaaaaaaaacatcatgcagattttaatgccttgggaggagcagtggctttctcttaaggacagaatttgcctcgaaatgatactcagggaaaaagagatgaagggaatcaatactctgacccaagactctcccttctctgcagtggtttgctagtcctctccttggtcaaacccaaacagaaaaccatagggcataggagtctaatgatgtaatccaagtcagccccctggaaggtggaaaaagaagggaaaatggatctggatctggagggataccaaaaaaaaaaaaaaaaaaaaaaaaccatagttggcatgcttgtttattgatattttcttgcatgatataagaatccagataaatatagtaagaggtctattttactaacaattttaggcacctaataataatactccttctttgaatgtataacctctagaattggttcagaaatgtaactgtgccgttacaatttctattagtattcaacagtagattcatatccattcatctatgactggagtatctgccatttgctggttagttactgtgtaaggtactttgtaaggtatagaaatacacttggggtgcgatggctcatgcctgtaatcccaaggatttgggaagctgaggcaggcagatcacttgagtccaggagtttgagatcagcctgggcaacatggtgaaaccccatctctacaaaaaatgcaaaaagagtacctgcgcatggtggcatgtgcctgtagtcccagctactcgggagcctgaggtagaaggatcacgtgaacccaggaagtcgaggctgcagtgagccataatggcacaactgcactccagcctggatgacagagtgagaccctatcaaaaaaaaataagaaataaatttgagctcagtgacctacattctagtgcagaaaaaaatgaccatagttgattatgagattttaaagcaataaaccacatgagacatactaatgagctcataagatcattcagaaattgtttattatgaacacatagtactttcagtgtggcattaaacagagatcactgtccttaaacaagttaaaagcagaatcaaatcatctgcaaattaacacaccactaaactttaagcttcttgagtgattctgtaatttttaaaatgtcttcagcatttcagtgtcaagatagtgcaaactcagtaaaagcttgtggaattgcattaaacaaaaccaaaataaatagattttattaaaactatatacaattgtctttctaatcatatcctctccatgaatagggaagaaataattttaggaatttaaatatcttctatcttaatagttcctcttatttccctcttaagcaatgttcactccttcaaaaatatttattgagcatctaatatgtacttaacactgtgccaggtgctgtgaagaatgccaaggaaatagaatgaacttctaattctttggagttccaattaaataacctaaagttaaattggtttcggagagaacattatgccttcgagactgtaggcttctcttgattagaaagtcttaaacattttaagtaactaaacagattaaggagaattcaaggatgcctctcactagtaaatttggattagtctggcaaacttcagaccttaaatgcaagatttttaataattaaaagaagagagaaaatgataattacatttctagagtctatgtttaccattcagccttcttaatcatttcctaagtatatctggtgatcaggattttataactccagaaaatctttctatacatcgcataaatctcttcttttaaaaagctcttcaattttgtattttgttaaaacttaaaagcctccatgaaaaatgagacaaaagtcagtgagaggctgtagcaataaaaatcagatgtgattttcttttgaataacatctgtttttacagtcctttcatgttaaactttataagaatttattataaacagctttattgacagttcaatcctatttctaaaaggatttattttcccccaatggtaagagttttcttttcttaaacctaactagttgcagatatttcagatactacatttctcattgtgtaaggtaaagtttctgaccacctgaatatgacttgtagctcctgagaacaatttgtttagtaccgatatcatgcagtgacattggtacaaaggaattttctttatttcactgtactgttttcagttttattctatagttgttaaataagaccattaaatatttttattagtcttatttcctgtttaactaggtgggtttttgatctctgttcagtaaagcattgtgctcttcagagcaagcaattgaaaagcaaatagtgagtatttctactgtaaaagtttaacattaaaagatatacacacagccaggcaaggtggctcacgactgtaatcccagcaatttgggaggctaaggcaggagaatcgcttgagcccaggagttcgagaccagtctgggaaccatagcaagactccgtctctaccaaaaaaattttttaaaaaatagttggatgtggtggaacacctctgtaatcccagctactcaggacgctgaggcaggaggattgcttgagcctgggaggtcaaggctgcaaggctgcagggagctgtgactatgctactgtactccagtctaggtgacagaatgagaccctctctctctcaattaaaaaaaaaaaaacaagatacacacacatatatttgcgtaggtaactctaatttcatttcaagtatgttatgtaacaaccatttgtgtagtgcttgtaacagtcaatatgtaaatactgactcatcttctttgacaattctacctagatacttattagagtcccccttagtcattgaaaggaaggttaaaatcaaaagacgttgtttgccaaagtaatgaaagaaaacttataaacacaatgtatcatgtctggggctgaactaaaacccttctgatatgtggtattaacagatcatctttcatgacagtaccagttattagaaataaaatgattggagttattattaatactaacaatagtggtattcttaaaatgacttccttatttatcttcacctttatacattctactactgcttcaagacccatcttgaattcttcttccacagaacattctgcattaatttcagccaacattgatttctctttttaaaatttgtcttgcacagtgaattagaaaaccaggaattggaaaaccagaaaagcttattaagtaagaagcagagaggagagagtttcaacaaagggccattctaaagtggtctactgcggacaccatactgattatagttggtgattaaatcttatctttccaactgattataaactcctccagggcatactcttatattccacaagatgcttatctgggtgcagagcatgcatgcagttggtatttgctgatttatcaactaactaaatcttaacatattattattaacaatttaaaataaagttaaatgtatcactctccacccctcaaagccatttctgttctttgttttcatagcaccattattatttcctgcatagtattttttaaaaaccgtatttttaaaatttatatatttgtttatttgggtatacttcactagattgtaagcgtcacaaaagcagaactattataaccccagccactaacacaatgcctaacaaatagtaggttctcaatatttgttgaatgaatgacctacagatattacttcattatgaaagattttgctaagttgttttacatctattttatccaaaactaaagttcttgaggcaaagcctagaatatcttctatgttctcacaatgctctgaatcagtgcttctcttaatatgcatagcaattgcctggagagcttgttaaaacatagattacttagccccaaccccagagatgctgattcagtaggtcccaggtgatgctgctgctgtcagtctctggcgcacactttgagtagtagggctctaggatgttatatgtacagacacatgctgaatagtgggctatgtgcttacttgctggctaaataataaatgttctcactgagtcatagaactttgaaatttgcaaggacttttgctattatctagtctatggatagcaaataacctgataccgtgctatagtgcttgactgcatttaacctgcagaatcctcatgagcagcccagcaccatcactccaagtgaaactactctcttcttgaggttgtccaattctatcaattaaagatgaaaaccaggttctgagagttgaaatctctggacttcaaaggtccaacagcccaggtcttctcaattctcgttagtgtttcagcagctgaatacaaatttattaagctgtatcagagtagtatctgtcaaattggagtgtccataatatgcttaaacagagaactccattccaataacatgaactttccttatgctttattcatcatcgcttgaaattttgaattttgcccaaagaagtttataccagtacatgttaaattacatcatagccttctttgtataaatcttagagtagtttactgaagtacatcgcaaagttttgttgtttcttaggtgattttaattatgtatgtttactttcagtaatgcatcttttctccttcatcaatattatgttatgctagctgtaagtacaaaataattgagaacaaattatgacaaattgaaccaagccacaaaaaaaggagaaaccaaatacttttgtgatttgagcttttttcagtccttgaaactttaagaatatctgtctttattaacttttgctttttgctgatggtttctctcattttattatagcttatagcattgtaaattaatttaacatgaaaggataaaaacgttgcttttgaaatgtttctcattaaattatgaaaaaatattacactaaataaaagaaaggaatgcctctggtaccagcttctgtttgctcaattattgcagtacccaaagtgaattattacacagttaactcagaggcaatattattgtcattatattataaaatagatgagttgcaatcttcaaaaaaaaaaaacagcataggtcctttgaaagtgaaataccttttttccttgtgcttcatttaaatatatactgaccccagttttgtttttgtttttcctttttagagttcttgctaatgatgggcccaaagttatattaagaactgcaaagtaaatttcaaccaattactttattcaggggagtcattaaattgaggtacctctgaaattttggaaggaatgtactgccaattagccgaaagcactactcaatgtcctttctatggttataatctctctagtgtatttttaattgaagacaacctctatagaggaggtgagaagttgctatttattggtacttgttaggatggaatcaagggtgtggaagatattcatctatttctctctccagctcccccacacaaaaagaatggtgcttaatccatctgaagcatttggggagcgagggtaaagatgtaatatttaccatgagccgaaacagatcttcagaagtggaaaatggaagcatattgaagtccctcaactaaacagactttcttccatatggaattcaatgcattaatgttttcaaattctatagcttcaaattcttaatattttcaaattatgtgagcttatgtcaaaacatttaagtgagcttttaacaatgaggcaaatatttgaatcatttgtctacataacaaatactactataaagcatattaaatgttataaaaatcctaatatactaatgtaagctattataaagtacaaataattaaacaatatttatatgatcaatgttttataatacgataaacacattaaataattaaaaactcttccaccgtgcaaaaatgactaaataaattgttaatttctaaggctttttgagattactgtgaaagggggtatagtttcaggaaaggtgaaacttcccttcaatgtgtaaaccattaaagaacataataacctactgagtgtgggtctcaatgatatgccctggaaagtatgggcaactactccacacccaattttgtctttatatgataaggcacagcaaataattataatgcaatggataaatggtaaatcccaccaaagattaaccaatcagagcaggatgaaaattctgagtttggaaatctattggaagatttacagattagattaaagtgcccagtaaccaaactatcaaaattatatggcttcagttaattaatgatttccaaggtttttagtatactgtattacaaaacacattaagcatcttaagcattcaaacaacatttttttgatgattcagaaagcatcacaaattgttatatcagctgataataacttaggtacatatcaattaaacttgtattatagacacgcagaattcttcagaccagaagtcgaaagggcttctctagtttgtttatgctaagttgtttagagatgacataactctgagctaatttgtctattgcaatggttctcaaaatggggggcgggggatatttttacctccaccaagtggacatttagcaatatctggaggcatttttaattattattactggattggagatacaactgaagtctagtgggtagaggccagatatggtataaaatatcctacaatgcataggatagccctccacaaggaattatttaggccaaaatgtcagtagtataaaaattgagaaatgctagtctaatatagtgtttactcacctttcctgaaactatgtcccctttcacagtaatctcaaaaagctttagaaattaaaaaatcgtttagtcatttttgcatggtggaagagcttttaattatttagtgtgttttatcttatgaaatgttgataatataaatattgtttaattatttgaactttataagagcttatattagtatattaattaggattttatttaacatttaatatgctttacaataatattcattatatagacaaacgttttatttttttcactttaacaatgatttttaactctaattacataagaaaaagtatgagttaacaattttttaaattacatgcttggtttgagggccaaatacacatgaaaatgtggactaaaatttaaaatcaaataaaatctataaagtcgaggaaaaagctacttttatgacgaggcatggggaattcttcatagtttttgggttttatcagaagttagctattttttttctttttgctctgtaaacaatcagataagagaggctcaaatgacattttcaagtacatcttaacaaaatacactttgagcatcaattgagtaaagtttcattcttttgaaactttggttttcacaagatttcctgagagttttattttattggtgttctgtgggacttgggcatcataattcttacaaactactcagctcaatctaatgtgcagcgaagctctgggaacttttgttttgtctagtatccagttggaagattctatagctacagagcttgggtttaaaccccctccaagtctttaccagctacctttatgaccctggcaaattacttaaactgtgtgccaccattttctcctctgtaatacggaggcaataaaaatttccacttttagattttctatatgcggtttacaaattgacttactctgaagatcatctggagtaaaatctggagaaatatgatcccttataacttcttcaaccctttatatatttcaacatgagtaaccaatgctctaaatatggatataaattataagaataaaaaatctaggactattataatggtctaaactctcttcatagctaaaagtgttgagtaattaaaccagttgagcagctaaatcatgtacacacttctttgatccctcccacgatcatgtatttggcattgtaatgaaaagatatgtttattttcgagaatagacataactacctttaataatatgatcacccagaaatttttacaaacccctggaaaatttcatgaatatcaggctgtgctcataaaaccttagagatgagatcacaatagactgggtcaacatatagtaatgagcaggattaataaaacctcagatgggcatttacaaatgagtcaaaaccatgagtataattaaataattgtagcaaaaaaagagccttgggtaatcctttcagcaaacgtaatcgaagtgattgcatttagaagacaaatatttaatttggtgactagaaggtcttttattattccattatgtctttgtgtgtgtgtgtgtgtgagacacttttcaaggtcaatttttacttataaattgtctctaattaaaaattgacttggttattaaatcattgaaaattggccatcatcaaattcctcattaaaatatttctatgtgccatatatatatatatatatatatagaatatatatgtagaatatatgtatacatttatttttactttttttttactgtgcctactagagaaatttaaactacatatatgtagaatatatgtatgttttaactagacatactgttaagtacactatacctaatatttggcaatattaataccatctcattgagaaacctggaatatatgcacattttggatgtctattatatgttgggcactggactagtcattgataatacagagattagtaagactcaggttgacttcagccatgttgtcaggaagcacacactctagtttgggacagcgaggagaaattcaataagagaaatatatataaggcataatgctctaggagaatatgcagtggataactgcccaataggaccaggcaaggctttttagaggaggaggtggcatttgagtcaagtgttaaaggctgaatggaaattcactggttgagataaactccttaggaggaactactttaatagaacttgccgttagtcctgaaataaatggtgtgcaaaatcattaccatctgtcaattcactcagtctactttgctcttaacttcagaaaaaaatcagaaatacaattaaaacatttgagcctattttactgtcttttaaaatgagttaattcaaagaggaaattaaatataatgagagagaatctcccccgaggattgggggctggggaaatgctattgattctttgcttgtgtttattttctctcaaaaatacattatgcataaacttgatgatcaaaaattcagattattacatttctaaattggcaatgcaatttattgcatcatacatcaatcacaaaaatgctcatcttgctgactttcataaacttctaaatgaacaaaaatgcaaaaatagtttatactatattacactatagtagatttgttaaactaaaccagaacaatggtccatgaaaaataggcctctgactccaaacgctcacaccacaggatctctctgagatttttgtgtcatttcaagtcagagaaaattgtctaataaattgttggcttgtaacaatgaaaactaagatatctgtggggctattcttgttctcttcattttactacagcagctctgcccagtagaaataaaatgtgagccacatatgtaatttaaatttctctagtaggcacactgaaaaaataaaaataaagaagtgaaattaatttcaacagtatgttgtatataacccaatatacccaaaacattgtcattttaacatgtaattgttacaaaagttattaattagattttttccgttaagtatttaaaatctggtaagttttactcttacagcgcaactcagttcagatcagccacatttcaagtgctcagtagccatatgtgtctagtggttaccatattagaaagtagtttgagagatccacattaaaccaaaaggaaaagaacttccggcccttcactgatgagtcactcttcactgctaaccttggaagcattcccaaatgtagtctacagagtttaaatagtctatcttaacatctctcagggcttcagtcttaatgccatagtatttttaaagaatggtggatattcttttttacagaacactctgtaagagcaattagaagtttatgatgcacgtaatgcaaaatacaggtcatttcccaagcctattttaaaagcgcaaaaactgtagtcatttatcacccctgagaatgttgtcttaaatgtcttggtttggatattggtgatgtgagaactttgtgataagaaagtagtctttaagaataagatatcagactaaaattcatatctagaatgaaagtcttgtttttaatggaagattaagagcaagtctgattcagatcatgcatggggtacactagtctaggaaaacactagtctgaaaatatactaaaagttacttcgcaacttaacaagaaaatgtcttgtgggtgatgtcgttcttgatttttaggcaaacctacctacctttgcaaagcagctgggacctttttgcattggaagaatcatttggagcacaaacaaaattagattatcaacactttggaaaacaactacgaatgagcaatcagaaacctgaccttaagattacttgtgaattgtgaatcagcaaaataaactcgattgttcattgctaagtgtatttcaattatcaagggccttctagattataagtagtcttttttttttacttagtttacaattaagatgtgtggtatttgaaatacatttgccacagggagaaatataaattataattaatttcctaggctaattcaatttatgacatacctatatacattatctgtcatctataatttttcccttattgtttacttcccactggaagaatgaaaatggaatattattacatggcacatggcttgatacttttacaaactctgacaattatgtatttattttgggaggcattgagtttatttgttttatttatataaatttatgaggtacaagtataattttgttacatgcatagattgtgtaatggtcacgtcaggccttttagggtatccatcaccttaataagatgcattgtacccattaagtaatttctcactctcataaaattctaattatgtgaatttaatttaatctatttaatgtgttttaggcaaatatagccggtactataaacagttgattttaagatatcattgcttacattgagactaagtaaaacaaaatgggtcaataaatgtcaatctagataacaatgtcaactaaataagaggtcaaacatggcagtatttttgaaggtgatctgtgaaagtgattatagcgtttacactcatggaaaatgccttcagagtttcaactaagaatgccaacagctcattcctttatcctgatgcatattgtcttccttctcacccccagttccttcttcccctaacccctacccgctttcctttgctgattttgacagaaataggacccccaataagtcagggagatagcaggaaatgggataggatagaacccggaatgatagaatagctgagcctgaaggcatgaagaaaggctcctcctgacatctaaatggagacctaagagatgggttggtcaggtagggggaaggaaacatgaggagtattctctaagccaggcaacatactgtgcacaagtctgaagtcatgggaaagtgattttgagaggattgctgcttggtaaacctagagtttgaattgggagagatgaagctagaaagttagtaagggtcagattttttttttttttacttgcatgacaatggtaaaaaccactaaaggttctgtgttaagcagaggagtgacttcatttaaaaaggtaaattggattgaaatgaagggcataaactgaggcaaaaatatccttcgttaagttattgaagcccagttgaacacactggtggcttaaactggagtattggtataagtgggggaaagaggttaatagattccaagttgaaaaaaaaaaaaaaaaacatagactttgctatctagtaatggattaatatacaaaaggaaaaagtaaagtttctactttttggacagctagaaaccttcaccgaagtagggaacccaagacttagattatgttgggaggggcagggtattttagttgcacagggatttgctttacagaaatgactgaatgacaatatagagagatcaattccattaaaagaagtttgattactcacagttctcaagggaagagtacatactacgccatgcaaagccatgcaggaaaaaagttccagagtcggtcagcaggcagaaaaggaaagcacagcccaaaccctttattgtggtttccaaggaaaagaaatgagtgaggtagaataggcaagtctgagcaagtttaggactggatagttcaaataatttccaaaatttcctggctgtaaaagtggtctctggttgtctggtaccaagccctagggtgaggggaaaaagttagggtgggggaaatattggtttggtgtaacaacagttagatgaagaaggtagttggggatacggactttggattagttggtttgtataacgaaaagcaatccaacaaatccacaagggagcaagtttacaagttatttgctatctttaggaattagctagccctgggaggggcagtctctccctggccttccaaggacctcaagatgttcaagcatccataaaatatggaaattttttaaaaacattataaatacacagagtaaacgctgggcatgatataggacagtggttctcaaactttagctccactggaatctcctggaaaacttgttaatatgcagatgaccgttttacccttaagcttctaattggggaggtctggggagggcacagataatttgcatttctacaaagttcttccatgattttgatgccgctggtgagggaccaggctttgagaacactgatttaggacgtgtcctgtttagggaatatccaaaaggcggacaagttcagggaatattcttgggcagttggctgtgtgagtctgaaattcaggatagaatattaagctgaaataaagatttgggagcttatctacagtcaaatgataattgaaatactgagagtacggggggagagaggtccatgtaccaagaaaagtgaaaatgactaatcccaagcctcgctgaccattgagaatggagctaagtgagaggagttaacaaagctgacccagaaaaagtcataagggccttaggaggccaaggaaaaaaaatacattcactgccaacgagaggcacttacgaatggcttgactggctttgccagcatgcatgaactgcttcataattatttgtattgattacagtaacagatacatattttaacaagcaacttaagtaatacaactgatttttaattatcttgtttaaattgataaaggttgtatatattcatggtgtacaacatgatgttttgatatacccatacattgtggaatggctaaatcaagccaattatcgtatgcattacctcacatacactttatttgtggtgagaacacttagagtatactcttagcaagtatcaagtatataatacattgctgttaactatagtatccatgttgtacaataggtctcttgaacatactcctcctgtctaattgaaattgtgtttccttcgaacaactgatttttttaaataaaaaacttaatacctgtaagttagaattcttaatggtcaccttaggagcctatacaattattcctacgttgttgttactattctgtgtctttttcttttttaacatctttaaaggtatcaaatttttatattttgaaagtagaatttattttttgtcagtctaaaatatttttatgttgaacaaaatgcatgaatggtaaacctagatgcaatcaatttttcaaataaaaaaagtagatacccatgaacatttcttttgtaattgcaaactgtcttgaaaggcagtttcaaaaagagtttagttcctaaattgtaccattactcactgcgttaaaatgcaacattcatttgagcgtataaccttttgatcaatttgtttttgatgtcttgttccctgagagttgtctcaaatagatacatataaatatacacatatctcagattggctctgagaaatgtcttgattcaaacgttcttgattctaagattcatggtacataggaactgtatggtgacaaccttgtcagcctatctttagagtagctttggattctattcagaacatttcccaaagctattctgctatcaagaatataaacaggaatagtcaagggaagctttttaaagggcaacattttcatgtaggcatttttctcacattgaaaactagtttactaaatgcagtgtattaccttctcattacaagaagtctttcacattagtataaatgcatatggcagttgtgccagaaataaattgcctctcaaactagcacatggaaagaagaattctgagatttagcacatatgtagcttttaaatagtatactctgtttcaaacattatgtgttagtccacgttctcttcagccattttcagttgcatttttactttatattcctttgtatatttatctttgctaatcattgtcctgagattcctttagctcttgaattctacgtttttaattaatagaaaactttctttttatttttcccccgacatagttgttttctagaaagaaacagttataggttataaatccaacactttagggccgacttgaacatgcatcaaagctactagaggacttgtagaaatacagattgaatggtcccatgcctagagttttacattcagttacagatagggtaggacctgagaattcacattgctcacaaatttccagttgattttgatggcattggtctagagaccaaaccctgagaaccattaaaaaacaaacaaacaaaaacaaacaaaccaaaaaaaaaactatatacagagattttcttcattggcttttgccactgaagacatttagatgaagagactccacaaagtgtaatcatttagttatgagaggggcctgataatttgcatttctatcaaattcccaggggatactattgttgctgattgagaaccacacttggtgaaacactaattaaaataccattaaaaagcaaaaacaatttaggccagcaaaacctcctaaagaatgaggcctaaagacttattttgttttatttttgccagaagcttcttatgggcaaaattatcaccaacagagctgaggttcaaacttgtgttcatagcaagcaaaagggataatttggaaaaaaagctgaggttagctttgtggttggtttgggagtgggaatgagtagggaggaagaaatttaaaaaaaaaaaaaaaaggaagaagccaaatattaaattgttcacagggcgaaaaaagagaaaaggagtaactagaaatatcttagactggttcggcaagtcgggtccctcgcagctaacagtggtcccaccctctggagtttatatgtttacattctttttttttttttttttttttttgagacagggtctcactctgttgcctaggctggagtgcaatggtatgatcacagctcactgcaacctccacctcctgggctcgggtgatccccccaacctcagcctcccaagtagcagagactacaggcaagtgccaccatgtccagctaattttttgtatttttttgcagagatggggtttcaccagttgcctaggctggtctcaatctcctaggctcaagtgatctgcccacctcagcctcccaaagtgctgggattacaggtgtgagccaccgcgcctcattggagtttgcattctagttgggaaaatagccaataaatttgtgacttattttcctttaaaaaaaaaacttattctggctattgtgtgactataggatatggaaggtgcaagagtatgaggctaacaccctgttctaaattccgtctcctctgagccttgttctgtcaagaatctcctccttctatactttttaagtcaccttcctactgatcctttgctgtcagcttaccactctggtacccttcattttaacaaacaaacaattgtccaagcttaccggtgctgctccttcacccctccacctgtacctagtgtcaattctctccctcttctgatggccaaactttgtgaaactgtagcacagctccatatgtgttcctgcaaaggacatgatctcattcctttttatggctgcagagtattccacagtgtatatgtaccacattttctttatccagtctatcactgatgggcatttgggttgattccatgtctttgctattgtgaatagtgctgcagtgaacatacgtgtgcatgtatctttaaaatagaatggtttatattcctttgggtatataaccaataatgggattgctgggtcaaatggtatttctggttctagatctttgaggagctggaagccattatcctcagcaaactaacacaggaacagaaaagcaaatatcacatgttctcacttaaaagtgggagctgaacaatgagaacacatggactcatggaggggaacaacacacactgaggcctgtcggggggtggggcgaggggagggagagcattgggaaaaatagctaatgcatgctgggcttaatatctaggtgatgggcaatagcaaagacttggaaccaacccaaatgtccaacaatgatagactggattgagaaaatgtggcacatatacaccatggaatactatgcagccataaaaaaggatgagttcatgtcctttgtagggacatggatgaagctggaaaccatcattctcagcaaactatggcaaggacaaaaaaccaaacaccacatgttctcactcacaggtgggaattgaacaatgagaacacatggacacaggaaggggaacatcacacaccagggcctgttgtggggtcgggggaggggggagggatagcatttggagatacacctaatgttaactgacgagttactgggtgcagcacaccaacatggcacatgtatacatatgtaactaaccttcacgttgtgcatatggaccctaaaacttaaagtataataataaaatatatatatatatatctctaggtgatgggttaataggtgcagcaaaccaccatggcacatgtttacctatgtaacaaacctgcacatcctgcacatgtaccacggaacttaaaataaaaattaatcatagaactttaaaaaaagaaaagaaaatgtagcagagctgcctagctcaccttctttacccacagctcacttttcagtccatttatctggctattactcctaccgtgccaggcaaactgctctcactaagaaaatcaatagcctaccccctgccaaattgcctgactcagcttctccttgtaattttctcctttagttctctaacaccctcttccccaggttttcacctgacctgtctccataggacatttgagtctctttcctgatgattcatcctcagcctcttccataataagtatggctgctccccagatcctaccctcagcacttcttcactttccatgccacatctcttctgtgatctcatcttcatccacggctctaattagtatctataagcagatgactctcaaagcatatgctgcctatgtacccctcttggccattctacattgacatctgcaactccccagtgaacttctatatttagaccacaggactggtacctgctgataagcacaggtagggtgtactgagtagtgttttctctatttggttgggcttttgctaaagcagttgtcaaatattttgagtcttactcatggccacagacattttaacattagcatgtcccaaactgaaatcccctactgcctctattctctatttcagaagatggcaccaccatctacccaattatttaagctagaaacttctgattctggtgagacttctctcttttatgcatatgtctacactgacacaaaagactgcaaattttacctcctaagtctgtcttaaagcagatttttctctatgattctctatggtttcaggcccttatcactgtgaagtcaagcatacctgattcgaatcttgtcaccgttggcaaatttttaaatctcttctagcctcagtttcctcataaagttttctgtttcttagggtgactaaagggcttaaatgagattaccatacagagagtaaggtacataaaatgcaattaataaagaatagtcactataactgctgatgatgatgctattactattcgtatcctagaaaactccggtaacttgttcactggtctttctgcatctagcatcacttcctcagccagagttatcttctgacatgaaggctgatgccgtcacccccatactcatgtttgaaattcttcaatacctttaagataaattcccacctccttggtgtagcatgcaaggtcacacatgacataatctctccaaggccccatttcttccactctccttgagtgatatatgtggcagaaaatttaaggctgcctggatattatccaccttacgtcccaatacttccatctgccgcaaagaccttctacccaacttcccatcctcaacgaattcttattctttctttaaaaataacctcaaacttcagactagacctctggtccatagggcattacaaatctctcagtaagttgtacaggatgaacacgccccctaaaactttgtttcagatatttcaatttttattttattttattattattatactttaagttttagggtacatgtgcacaatgtgcaggttagttacatatgtatacatgtgccagatatttcagtgttaaaggtttaataatcacatttacagaaaaggaattagctacaaaatggtggcactggtatacaagtatgtaaagatacagtgcttacaatttaggattattgttgtcgatgttttaatattaaaatggctaatcatacagcaaagtcgaaagaaatttacggtcaacatctgtatacccagcacctatactttgccattgaaattttactatacttgatttattacatattcatctatccatccctctttctgtgatcaatttttaatattctaatactcttacccttaaataataagttatcttttcaaaaaataatgtgtttttacatagatgaagcaaaataaacttgcccttgataaaacaatatgcactgtagtgccttctaattcagtgcattgaagtatccattaacaatataaccagagaatataaaacatgtttattaatattccactgtacctgattagatatagaccattaggaagagttattataattaagaatctaggtttgtcaatatagaaaaaaacctgtgttttttatcccactggaatgtcttgtgaggaatattgttcccctttttctaaaatttaactttgacctttattttgttaatgcaccatgggttaagccacactacgacatgtgctaaatagacctggaagttttcaaactaggtttttaaagtgtatttgacattaaatcttcataacaccttattgattaatttaaatccattaccatggtaaggaaaattcgcagacaggcaggtgaaaattaaaatagaaacaaaacaacatggtaagcaatccttccccccaagccaatcagcatgtagtcagtgtgtccttttaaattagcaaggcgcagcttcccataaagtcccagcttgattttatatgctgcaatagtattgctaaaataaaggagaaggcaacttttctctataatttttttctagaagttttcacgcagcttagtatactgcaatgaccacattactcagttccagaattagcagcattccattgtgaatgacttaattcacattgtgattactcatttaacaacattcttgagggtttacaatgtgcaaagcattacattaagtcgtgtgtggcagaggttctcaaatgcagatgatctgtgaagaagatttcctcaataagcagagaaatgagaactataaggacagaaagagagagagagagaaagagaaattatttaagcttgtagcttgtcatcctcctttcttaggacagcctaccatttaggctgagactatgtctttctgattatttcttgtggttgaaataccccttccttaacaatatgatggtaacagtggatggtaaatcttgttttgttttaatagtttacctggcaaaagtatcattttatgtctgtatcagttatatataatagtatatcagtccattaccaaaccgcctcaaaactcagtagcttaaaacagtaggtacttcttgagttcactaatttgtgggctgatggtttacattgggtagtttatctgctctgactgggctcccttgggaatctggagggtagctgagagcttaagtgtctgaaagtggctgggtcaacacagctctatcgctcacatcttgaacatccctccagcaggctaaccagcccgagcaagtcctttttgtgaaggctgaggtgaagagtggaagtgcaaacatgtaaacaatttgttgagcccctgcttccattaagcctgcaatatccgattggctaaagcaagttttatttccccctgtggtaggcagaatcatgggcccctcgaagatgttaatccccagaacctgtgaatatgctgtgctccctggcagtagggaattaatattccagacggaattaaggttgctaagcaggtgactttgagatggggagattttatggactattcagatgggcctaatctaaccacagggttcatataagtgaaaatggaagcaggagagtgggagtcagagagatgaagatagcccctgctggctttgaagatagagaaaggggccattagccaaacaatgttggtagcatctaatgctggaaaaggcagggaaatagattgtcctctaagcttcttcagaaggagtatagccctgccaacactttcattttaatccatgaaacccatttcaaacttctgacttccaaaactataagataatcaatttgtgttgttttaggccagtaagtttatggaaaattgtcacagaagcaataggaaacaaatatacgctccattgttcaatcttttgaataacacatatactattatttacttaatgtttttcttaaaatcagctcattttgttttctgcttttagccttaagtgataattcccacaaaactgtagtctgatgttgcagtgtttttttccttaatacagataaaactaaatgaatattaaaatttaaactataagctgtttatctgtgtaacatggtaaattggctccctaccactactgttcagcaaaccacattttgggaaacagcgatttaggtggttcaaaggagcaagtgattgtgcaagaacaagaatttattagagaaagaagcatttggccaatgggtagaattgttggcagacaaaggtagaagagaaagacaaattattcagtatggctctagcgaactctttgcacttttatcacacaatctgaagcttgctaatcttgacatgtcttaatgttgttggattgctcattaaactggctgaaatgttcacaaagactctcacctgtcttctggcttaagctgagatttatcacacttcttggaaacatcttctggtctccagatctccctcagctaagctatacagtcagtctgttctgtaagaaagcccaaacttctctgcagtgttcctcagtctttttgatatcatgatgaacagattaagttgatgtgttcatcatgatatcaggtaagctggccgaagactctaagctgcctaaccatcccagggctgagagggatcgatatctgaagtacctataacccaatcagggcatgtgccttagcatacccattggaaagccctgttttagagcctttatcagctgtgaacttattgaaggcaatgattttgtcctgttaatcattctattcataattttcaacaagatacgtggttgttgttaataataattgttggttgaaatgaagttaaataaatagcaattgacttttccaaggtgacgcattgcacagatttatttatcttccctttgctgccctggagtaccagttgtatctaccaataagcttcatttataggccagcctcatcttagtttctgaattagtctaagtggctctggtagcgcatcaaaaatcttgctttctgatggtctttgtaatttgaattctgtgacttacagacttggtattcaatatgtcaggaataaacctggggtgtgcccaaatggtttgaaaaatcccagccttcctgatttcctctcttctctttctcccctggccaccctaatagtctgatagtttttgttatttggatactcctaaactcttggcaatttttcttacatctgttctctacaggctgtcacaagtgagtggaggcaggatggcatgggctgcagtggaaagaccaagaaaataagttaaaagccctgggttccagtaaatgctctgtagtgggatttagggcaagtctcttaacttctctcagcatcaatctccgcatctgtgaaataagattaatgacacctgtcttgcctatacttcaaggttgttttgaggttcacatgcattttccaccccatatagcctataaatctctgatgcctacagataacctataatgttctccagtaagtttaatatttccaggattttaaaactcaatgactagcactgctctgatctaacataacatattgtgtcaatatgtgtgggagtctctctggttgatgttaatggaagtttgtatagtttacctaaaatagaataaagctataatattaatatatatcatcgatgtgttttaggtgatttttttcaatataaaggcaattttggttcaaaattaggtagaacatttaatttttactaatttacaaataaaatgataacatcaaaagggccccttcttttaaagataagttgtaactctcacattgatagtaatctgtcatttaggacagggaatccatgtagtttgaaaattcattggcatcatggagctaaaacagtggctttttaaacatgtcgatttcagttttctttgttttacaagtcaagtagtgatattactgggtacatatgaagcatactgattgaccaaaaaatagtaacaaattttgtaaacccttcacttaaccattattcacctttcccagccacataagaatcctttctctttgtccttagattaattgcctttctttaaccttttcaattctaagtccagacaagctgctgtggttctttaaaaggccacacaaaataagtattgtccagtgctaacactctgaaatgtgatattgtaattactaccaagtgaacattaatcactactagattagaatggaattacctgttatattcacattaatagcaaatgagctttccctgattgatgttgttataatgaatacaaaaggaattaatagtgatctggcactcaccaaaagaggggtagtcattaaggacatgccatcaaaaggcgggtaatactttacaaaaaacaagtattaattaaagtaatatcacaacgaatgcctattgaataacttatatccacattacaaagatattatatggttgcgattaatgtgattgcaatacattttgtaaaaattaataatgactaaccctttaaaatatttaggaagcagatatttgtttatatttgctaaatagctatgccaactctttagcttttgtgagtgacttctagcataggaacagtgatggataatatgaagcactatatataataactcatcggccgggcgcggtggctcacgcctgtaatcccagcactttgggaggccgaggcgggcggatcacgaggtcaggagatcgacaccatcctggctaacacggtgaaaccctgtctctactaaaaacacaaaaaattagccgggcgtggtggtgggcgcctgtagtcccactactcaggaggcagagcttgcagtgagccaagattgcaccactgcactccagcctgggtgacagagtgagactctgtcaaaaaaaaacaacctcatatatttttacttgaaaacatacattttgcctttaggatttttacttgttagaatatcctaaaggacctataattgtaaatgtaaaattgactaatttctgggttttaaaaaaaagtatttgaaagctgatctgctgtgaacattgaaccagatgttaagaaaaatgctagtaagaaatgagacttgggagcaaagaagcagaactaaacttttcatatatggtttctatggagtaattgagaacgtacatattaacagggatacaaagtcaggccctctcattcaagatgctttctgtctttaaaaaaaaaaaaaagtaatttttgaaattttctgtggcaacagtcccatagcagaaagcaaagagttttgaattaagtgatcagaatatcattcttataattttactacactgaacattatttagaaaattttgaatgatattaaaaccgctataaaacatacttgcctaccataagacttaggatttaagccagattaaaataaatatttatttagaaggatgtatgtaagaactggtgaaatataaatgaggtctgtatttgagttaatagtattgtgccaatgtcagtttcctagctttgatgataatgtactatgggtatttaaaatgctatcattgggagaagctgggtaaaaggtgcgtgagaagtctctgtactatatttgcaagttttgtggtcttaaaccatttcaaagtaaagttattttagaaaatatctaaatatatattttagaaagtattatctttttctctgtaactagtggctaattagctcagtctgaaagagtatgtagaggtggaactgctaaatatatttctgatctagacttacttgatgatgcttgaattagtaagtgaatgttatgtgccaacatatgctatgatacatataaatatataagattaaatgataggagctaattatttcttggcatgttgcagtgggtccatttaaaactgtttatgtaggaaactactgtaattataaaaatgagcacagcccaacagcccagtatattagttgaaatataaaaggcgttgtgtccaagatttgaaatgccttacaataagcttggcacttacttaccttcacacaaagcagacacattttattgtgattttagtgttccatattatatggtacagtaccaaaggaaaactctaaaatatgtactcaaaatcctgatgtgcccttctttccaaacaggtggcaccacaatgaatataacctttagagttaatatctgaggacaaacccagcagttacaccagcatgatttaggtcctgctgttacaattattattattgtatttatttcacaattaagttgcagagttgagctcgatatagttccagctgtggcttttttttcaactgtctcaatagttcatagatatggccaaatgttcaataatagtgaaagcttatagtccacatattatttctgtagcaccaattttatgtgaaaaaatgatttatctaaatctcagagaatttccataactagttttgttatacatctacaaaactaagttaaaagaacagagcagactttttaaatagctagattggccaaatccacctcattatcatcaagaagatactgaaacaccgtgtttatacaacaagaccaggcattgtaaaagaggaggaaaggtagagacaaaatttatttagccctcaggaatctttcattctgatagtgtaaatttgacaactttagagggacttattaacatgtatcttatatatcttgataccgaatatatattttgtgattgcattagagccatgaaatattacacaggtcatttgaacatagcattttcatagagaaggtgacatttgcaaaagattaggagaaaagtaactacgattagaaaatcgtagttttattttgtctcttgagaatgaattgatgttaattttatgtctgatttggccaaatacgatgtggaatttgctaaagactgaaaaaagaagagacatcaaatagagggttgcaagttaacagaccatgttataattaaatgagggaaaaaaaagtagagttgttaaactcccagagaagtcatttccccttggtttggtgcatttcactttggtggtgaagtaaatgaccatatgggcacttttctagctctgtccgcaggtagcactgggtatttgtggacaaattacctagcttttcatagcactagtttccttgttgatagacttcagaattctaaattccattttacatccttatttctatgtttaacttaaagataatcctttgcagccgggcacagtggctcacacctgtaatcccagcactttgggaggccgaggcaggcggatcacgaggtcaggagatcgagaccatcctggctaacatggtgaaaccccatctctactgaaaatacaaaaaatcagccgggtgttgtggtgggcgcctgtggtcccagctactcaggaggctgaggcaggaggatggcatgaatccgggaggtggagcttgcggtgagccgagatcgagtcactgcactccagcccgggcaacagagccagactctgcctcaaaaaaaaaaaaaaacaaaaaaaaaaacaaacagatcatcctttgcactggaattatcctgcagtggaggatagtaatgaaagtgtagactctgtttctgaacactagctatgtcactttcaaactgtgtgattttccttcaagtttctcaatcactccaggtctggtttctaaatagaggaataggagtagagattaatattgtgaagattaaatgagaaaacttatataaagcacttagtacggtgccctgcatattgtgaaggcttggtatgttgttagtagattcattttattatcattattaataatactgaaccctggctgttgggggaattggttctatcctcctgtctcatagtcaaaataggttaaagggccttctatctcttatttctggtggtgcattataattactaatagtaatgtgcttcatttgtatatgatcctttatagtttacatggcgctgttttatgtaatcttactaaaatttcaaaaataattttaaaaagccagaattcacaagaatgtgactcggagaagaagtagatgtttttctaagtagatctttcagtttaactgattcaaattttctcatgtttcatatacatgattatcatgtcttttgataaacagaatgttaaccagagtacaaccttgtatgaacatatttattcagcttagaaaagatccagaggtacaaaatctagatcccagtgtagaagttagcatacacagtacaatttctagtatgtccataaacaatatgttaaagtattagtttgagccatataggattgccaatatctgagtgttatagagctacaaaattagtaggaaattttgttgctttaacctaatcattaaattagaattgtgtgacttaaagttacaaatggtttccgaatattttgcagtaaaaaagtagtgaggaaaataaatataaatactaaactagacctgggaaatttaaggctataaagaattctagcttacagagagaggagtctttgtttgcaacctcccactagctaaatttaaattatcacaaatttcatcctctcctttacttaacccttgactcatgcaactagtcaaatgtctttttcttgctaattttttctttccatagatcacttatagggagttctggttaaaaatgatgtctctttaaccttcactaaaatgagaataggggaattaaaatgatatttaccacaaagagaaaaaaatctgggaggaaaaacaataaaataaaaaagataaaaaatttaggaatatgcagagaatggaggagttagcatatcttggaaacctgaattccaagtacttagaacttgggaagtcctagaaatgtgaagcaccagctactgcagaaggcagagatgaatgtgaggtaagatagtgagactgtgaagagaaatcattcagtaaaaaatgcattatcaagccaactgccactggtctagtggagtttaatcccactggggaaattctaaatggattgaagacatgtgtttaagagttagttattctttcaaaggggcaagggagctggggtatttatacacaaaatcctgctagtcattggtttaggactgcttccaacgggggaattattttcctagcatttctggcataccaccttggcaagaaaaattattttgtgtccagagtatgtctaaagccattagggaaaaaaaatgtggatcctcatagttgaaagccaggccagtctgcactaaagtggtaaggatgttttcttttagagatacaggtctaagaaagaaatctgaaggtggttacctcttatgcaagaatttaatttgatggattcaaggtgtgttggttaagagaaatggggaagggttgcttctcatgactgcggcacgattctactatactaaatttttcttttattaagcagcattgccttatgcaatgataggaaacatttgttatatgtgaaatcacttttatttttattttttaatctattcctattcttttcatttttttaacttttattttaggtttgtggggtacatgtgaaggtttattacataggcaaaccggtgtcacaggggtccgttttacattttatttcaccaccgaggtattaagccaactactcagtagttatcttttctgctcctctctctcctcccggcatctcttttaaaagaaaataatttttagcaattctttagaataagtcttggccacctaaaggtttccaggactctagttcagggagtatttatctaagtcagtagttcttaacctgatataatttcatccccagagaacatttgacagtatctcaagaaattcttggttgtcacattgggggcggggatactgctgtcatcaagtgggcagaggccagggatgctgctcaacatgttgtaatgcacaagacagccccccacaacaaagaattatttggtccaatatgtcagtagtgccaagtttcagacatcctgctctaaatcaggactgtgatgtgaattctctgcgatgatgaagatattttatatccgtgatgtgcagtactgtagcatatggctactgagcaattgaaatatagctagtgtgactgtacaccaggtgtgatgttccataccgaggaaagaagtagaaataagatatagtctttgaagtcagagctcacaatctagtagcggagacagatttttaaaaattacaatattttaaaaatattgcaatagaacatggtaatgttagaagattaataacatgctaaatttgaggcatcaggactcagacagacaattaaaaattctctgaggtgaatttccacccttagctcagaatactgtaatgtttaaaagctgttttctatacacacacacacacacacacacacacacacacacacacacccctttaaatcttttatcatgtaactcattgcttcttattttacccttttgtcagagaatacatataaaatactggaatctgatgggacattctactttatttaacaatgctattgagtttctcaaaatagtttcctaagaaagtctattaaagtattgattttttcataaaggataatacaaatggcatgagtctgtttaacattttaatcaagcttaaaattagtcttgcatttgaaacaaacttgcccagagaaattgttgagaaacttaagagaaaaacatcataaaaaattgatgggccagccaggctgtgagaatattaaaatccaaatctaaattatggttaaccattgtcacatctttctttgaagcttaagtaactcgatattccctgtaggatacccagtgattcaaagtgacacatatactgtcagctcattttccttcccagcatgctggtacaatttgtatccatagaaatatatggaaaaacctattagtcttgagtgccagaacctaccaaaaggaatctttgtcatctacaaataaattaataacataagataaacaatcctattaagttatactggcccgaaaagggaaaaaagaccagtttatgaattgacaaaagaaggtaaatgagattagccatatagcaaccactcagataataatgtgttttctctgtttagtaaaaaagcatatttgagagaaaattttcccttatagaacaattcttaataatatacatagatactcctttcctgggatgtagagtttaatcctcccctaagcccctccatgaacttggtaacttacttccagataatagaatatggaaaagtaggaataacaatggagaagaaaccaggcaggcaccaagttaactaagtagtcaagtataacatcgccagtgataataatattgatatcatgtctcctgtgatatgatgtcatgaaaaggacatgttatctctctggtattcttccccaaaacctgtaacttcttctaatagggaaaatacttcagtcaaatcttaagagacttctagaatatacctgactagtcctattcaaaagtttcaaggtcatgaagaacaagaagaaactgagagactgtcacagactagaggagaccaaaaagacccaaggaccaaatgcagtaggagattctggattggatcctgaaacagaaaaatgacatgagtggaaaaactggtgaaatctgaataaagtctgtagttttgttaatagtgttgtatcagtgtttgtttaaatgtttagataaatctctcatgcgtacagaagagttatcattaggggaagctgtgtgtcaggcacttagaaaactttcagatacataggtaccttttgtaagtaaaataatgaattaatgggtcattttatgtctgtattttatataaggctacatttctaaagagacaaaattgtgagtcccataaaaatataaaatgaatatgtgtaaaacattttattagatcattaactgatgaaggaattagtaagatgttagttacagttggttcaaaggagagtctgaagaattggcatatatatatacgtatatatacgtatatatacgtatatacatatatatacgtatatacgtatatatacgtatatacatatatgtgtatatatatattttatatatatacacatatatatataaaaaacactctagaatgctgataggaattttataacagatacaatactgatcactaactgtagggcaggaatctattgcgttccatgagaaaattttactggcatctagtgaacaagaatcatttgtgtcaccatcagccctccacaaattgacttttaaacgtacagaattgcaaaatagcataaccaaagtctaaggtacagactcttagataatcagataactcctaaggttttcctaaggaattaaagggaaagagacattctcagattaaggaaaacaaagaatttcttgctagcaaatctgctcttaaagaatgacaaaaagacattctctaaacagaaaggaaattataacgaagtcttgacatttcagaaagaaaatagtagaatgggtaaaaatgagagtaaaataatagactatcctatttaccataagtttgaagtgaaaactttaacaccacctgatgtggttctcaatgtatgtagagaaaatacttaagagttatattttaaaagaagacatacctaagtggaagtaagagtccttctacacgtcacctgaagtcaattccagtagattgcaatgttaatgcgtatcgtaatgcctggaaagaccactaaaaaactatacaaagtgatacgttaagaaaatacaacaaataaattttgatggaatcttaagaaatgttcaaataacccacaagaaggtaagaaaaaagaaagagaagaatgagaaataaagaaaacaaacagaaaccaaataaggtggcagattgaagccctaatatatccataattaccttaaatgcaaatggtctaaatataccaattaaaagagatttagctgagtggattgataaaagctgagcacacaatatgccgtctaaaagaagtttatttcaaatacaacctaggtaggttaaaattaaaagaatcgaaaaagttacattatgcaacaattaatcaaaagaaagcagcagcagtaatgttaatatcagataaagtaggcttcattgcaaagaaaattactagtgacaaacagggacattacataaagattaagtgttaattcactgggaagacataataatcctaaatgtgtttgcacctaacaacagagcttccaaatacatgaagcaaaaatgaatagagctgaaaaaagaaacagacaaatccatatttctagttagggacttcaacactcctctctcttcagttgatagaactactaaatggaaaataagcaagggtaaagagaactgaacaacaccatcaaccaataggatctaattgaagcactcctcccaacagtagcagaatacacattactttaaagctctcatgaaacattcactgatataagccatattctggactccaagcaacttcagcaaatttagagaattcaacttatatgttcccagaacataatgaaaccaagctagaaatcaataagagaaagacaaaagaaaaacctcaaaacacttggaaatgaagcagcacacctttaaatcattttccccaggtcaaggaggaggttgcaaagaaaaattttttaaacacaaagaactaaataaaatgaaaataaaacatcaacatgagtgagattctgaagcaaagggcaagcatatctactgtctatttttaaagattaagcttccttaagctcagggtttctctcctgtgatgcaatccactgtgtgtacaggtgtctcctgaacttctttgggattactctgtgggaactggctcaataaaatgttggttctttgactactgctttgctgtgagtaatctagtctttttctctggcaaaaaaaaataaagtgagatgtcataaaagcagtattgagaataaaatgtatagcattagattatttagttagaagacaggaaaggtctaaaataaataaatgagcctagagacaaaaaccatcaacaaaatattaaataacatgcgtcaaagtttaaaaaaagagtgtcataccataactaactgggatttagtattgaaggctggctcaacatttgaaagttaattagtgtaatctaccatatcaacaaactaaagaagaaaaaatcatatgattatattgattgatgcagaagcatctgacaacacccagcatccattcatgataaaaactatgagaaaactgggaatagaggataacttccacatcttaataaagggtatctacagaaaactacagttaatagcataattttaataatggaaggcttaatgtttccacccatgattgctaattagggaaggatgcccaatttcactactcttttttaacatagttctggaagttccagacactacaataaagcaaggaaaaacaataaagcatgcatattgaaaagtataaaataaaattatttctatttgtggatggcatgactgtgtacgtagaaaatatcaaatattctacaaaaacaaaagcaaaaataaccaaaaatgctcatggagctgagaagagaggttaacaagatccaaaaatacaagatcaacacaccaaagctagtcacatttttatatacagatgctcctcatcttatgatgggcttacatttagataaacccatcataaagtcaaaaaatcataaggcaagccatcacaacttacggattatctatgttggaaatgaagatgtgaaaagtgaaattaaaaacacaacaccatttataattgcttatccaaaaatgaaatacgtaggtataaatctatcatacatgtacaggatcggtatgtagaaaattataaaatgctgatgaaaggcattaaaaacaacctaaataagtggattatatggcatgtttatagactggaagagtcagcatagcaaatatgtcagttcttctcaaatcaatctaaaggtttaatttagtttctatcaaaatcttatcaaggatttctgtacacatagacaagcatactctaaaatctataagaaaagtcacaggccacagaataactaaaacagtcttttaaaaaggtaaataaagtgggagtaacctctctacccaatattatggctaacaatatagtaaggctatcaatacagtatgatgttgctggagggatagactcatagaccaaatgaaacagaatagagaacccaaaaacagacccatgcaaatgtgcccaacagatttttgataaagttgcaaaagcaattcaatagagaaagctcaccttttcaacaaatggtcctgcagaaattggacatccctagagtgggaaaaaaaaagaacttcaacctaaatctcacaccttgtaaaaacttaattcaaaatagatcatggacttaaatgtaaaacataaaactatcaaaatttagggaaaaatgagaaaatcttcaggctctagggctagaattggcattgaaagcatgatccacacacagaaaaaaatcagttggactgcatcaagatttaaaacctttgcactgcaaaagacctgtgagggaggatgaaaagacaagctacagactgatagaaaatattttcaagccatatagccaaaagatggatgtctagaatatataaagaactctcaaaactgcaaggtaaaacaagaaacaaacaatgcaattaggaaatgggcaagacacatcaagaaacgtttcaccaaaaaggatatacagatagcaaataggtgcatgaaaagattatcaaaaacattagccattagagaaatgcaaattaaaattattatatattcctacacatctatcagaatggctaaaacaaagtagttacaacaccagatgctagcaaggatgtggagaaaatggatcattcacatattgctggtggaaatgtaaaatggtacagccactgtagcaaactgtttatcaattttctgtaaaactaaacatgcagctaccatacaacccagcaattgcactcttggacatttatcttacaacctgtacaaaaatattcataccaccattattcattatagccaaaaactggaaagaacccagacggtcaacaatgaatggttgtacaaactacggtacatccatacataccaggcaatactattcagcaataaaatggaatgaaatatttatacatgcaacaacttttagatcaatctccacagaattatgctgagtaaaaacagctcatctgaaaaggttacataatgaatgattctgtttatatagccgtcttgaagtgacagaattaaagaatgaagaacagattggtgattgcaaggagtccgggacaacaggggaaagagagagagagagatggatgtgactccaaaagggcaacacaggaggcatccttgtagtgttggaactgttctttaccttgattgtgtcaatgtcaatatcctggttatgatattgtactatatttttgcaaggttttaccttcagggagacggggtcaggggtatactggttttctctgtattatttctcacaactacatgtgaacatacaattatctcaaaactaaaagtgtaatttcaaaaaacaaataaaacaattcagaaattttaagacttcaacagtcatttatctcatttgttattttactgttgagaaaacaggcacaaagaaactgaagtgacttactttcatgcttcacctaagtctttttttcttttctccatcactcagttaagagcttctgtaatacagaaagtatgtcttgtattcttttaactcccatattacttcaagcaatgttgaacacatgttaacattgtaaaagttgttgtctgagtaaatgggaaagatagaggtctatgtctatatgcaaatactttgtattaacatgtttcagtctgatataactttccacacagaaagtacaaaagaagatctgttcaagttatctgatttaattaagatagtaaaaagaaagctgataatttagggggtcttatttgattgtttttaattttacttattttccactaggtgatcattttgatgattcaaaaatgaaaatttacaaaaaggtataaaataaaaattatttctcctacctctatgcactgtcgaatcaattcccctacccaccaccaatcagtattgtcagctgtttgtatatccttcaggagatatgtacgaatttcaagcgaatatgcataagtttatgttatgtatatgtgtgtgtctgttttctatatatatgcatctttacattaatggtagcatacgatacacattttcttctgaattatgcttctctctcaacaatgtttcttggacattttcctgtatcagtacataaagaatgtatttgtttcctatgactgcaatagtgaaataccacaaactggatgacttaaccaaaagaagtctgttgtcttacagttctggaggatagaagtctgagatcaaggtgtcaggagggttggttccttctgagggctcggaaggagaatctgttccattccattcccctagtttctgatggtttgttggcaatctttggtgctccttgtcctgtagatgtctgccttcattttcacatggcatgccccctgtgtacgtgtctgtctccaacttccccttttaaggacagagtcatattggactcaggcccaaccaaatgacctcattttaagttgattatctctgtaatgaccctatctccaaatagggtcacattctgaggtaccaggggttaggacttcaacatttaaatttggagaaaatttggacagaattcaacccatagcaaagaacttaaccgttagtttaatgactacatattgttccattttgtggatgtatcataatctatttaagcagtgctctgaacattttattggttttcactttcattgttttgccttaatattggtgtctgtttcatagaatagatttatagtattttaggcttatcaagattttatttaaatcttggaatttaaattccctgtaaatttcaagtgccttgaaggcaagatatattgaggaggggagacttttaaagttcatatgaaataataaataatcgcaagtatctcaggaatgcatgaaaaataataaatgtctctgcatcaataataagggagggggcttgccttatccaatattaaacttgctgtaaagctactgtaatccaaatagtatagtattagcacaaaacaagacaagtagatcactgaagcaaaattgagagtccagaagcagatcagattgtttttggaggccgggcatggtggcttacgcctgtaatcccagcactttgggagtctgaggtgggtggattacctgaggagttcaagaccagcctagccaacttggtgaaaccccgtctctactaaaaatacaaaaattagctgggcgtggtggtgggcgcctgtagtcccagctacttgggaggctgaggcaggagaatcgcttgaacccaggaggcggaggttgcagtgagccaagatcgcaccattgtactccagcctgggcaacaagagcgaaactccatctcaaaaaataaataaataaataaataaatagatacaaattgtttttggaaacattatatggcaaatgtgttattttaattcaaggaataaaggtgttttattcaataaatggtgccagcactctttgcaattcctcttagaaaacacagattgcctcctagcttatgcaatgtaagaatacatttcaaatgcattaaagttttaaatgtaaaaacaaaaattcttggaatgaggaagacgttttctaaacaagacacaaaactcaaaagctataaggaaaaaatataccttgttactgcttaaaataacagaagacaaagtcaaaagaaaaacagcaaatagagtagatgtattcgcaacatgtgacataaagagatgcatatacctaatatacaaatttctcctacaaatttgttaattaaattaatattttttaaaattcaaacaacccagtacaaaactggccgaagtataggaatatgcaattcccagaagaggatatccagatagctggaaaaataaaactatgataatatgcttcctcatagtagtaagggataggaaaataaagaaataagacaccatgtctatctaacaaatagacagaaattaagaatgataatttttaatggaagagagcactctcagatattgcagatgaaacgcaaattgctgtggtctttgaggaaagaaatgtggtatgatctacaaaaattttaaatgcacttaccttttgatcagtcactccatttctgagaatcaatactacagaaataaaagtaccagtatgaaaggctgtatgtagaggatgtgtattttggcattgtctatgatggtcaaaaagtagaaatcaagcaaatacccttcagtgtggaaattattgaatatgttatggaattatttgggcatcccagaatgaattattatttagtctagttagagctgtgtctactgtcctgaaagaatggtgatgatatctttcaaaaatcaaaacaagtttcaattaacatattccatttttaaaataaaaaagataaaattaatcttatgggattacataaccatgaaggaggaatggagagatatatactaggttatcagtatttgttaccttggattttcaaaggagaatgaaagaggaacaaataatgtatcaagtttcacaaaaagtgaaaaggtggaatataaatattactgcaaatatataaccattgaatatgtatatggacaaggacgataagataatatagaaaactgaatatgttggttttattatgaggtggttggattgaagatatttttgtctccaaatactgttgttttaatatgttgtgttttacaaagaaacatgggctgagcagacagggaagccctgataagcatagtacctgccatgtggccattcaataaatgatagttattgattattattattagagttgtagtacagtagtgcctaccttaatatatttagattgatgcccagcagcattgagttaacccgcattttaaggacaagtgttatagctattatatactaatggtaaacttgagtctgtaactagcactgttgaaggaggacaacagagtaatatgatgtgtattggcctggggatggaagggtggtgcttaaggcacagcagattttcactccagccaggtttccttaggacctctccaatgaacaggatacctcccttcctgttctttctaccctcccaccccgttttttgctttttcagtttcagcccaaaggggaaggaagtatgatgactgactccccatcagtccctgaggtgaactgggattttgggagagtgtggcagctgcaaatttggcttcctggagataggatttttgccctcaatctggagaaagttcctgaggctacagctgttcaagcttgtgaagtaggaactttgatcccttttttcaaaagttttgtataattagcatccaacttgttagacagtatgtggctcattacaagattgccacaaattcatgctgggccgtgtctaagaacagggcaaagggagcctttggaaagtgttatacagttgaccctcaaacaatgtgagggttaggggcgctgagcccaacacattgaaaaatctaagtagaacttttcactcccccaaaacgtaactactaataggctactgttgacagaagccatactgataacataaagagtgattagcgtatactttgcattgttatatgtaatatatactgtattcttgcaataaagtaagttagagaaaatacgatgttactaagaaaatcataaggaagagaaaaatatatttactattaattaagtggaagtggatcatcatataggtcttcattctcattatcttcacgttaagtaggctgaggaggtggagggagaggaggggttggtcttgctgccaatctaaatgctgggcccagccaatgggtataagttttaagtgtgcacatattggtgaacccttacagatcacggcactgtctgttcgagtgtctattttgaaatgtccctatccgtaatataagttgcaaaggagtttgtgggcccactgaattctaccaccctgatcattgtgaagcccattcagctttgtgaagagcttatcttggtactaccttagccaaggtatgataactcagacataatgtcttttctttcatggttccttttttagtgatcatagattcagttctgtaataattagagatttatgtgtcctattagtaattgcatcattctttaaagacagtgtcaaccttgctatacagtgtgattgaagccttgacataacttgggggtttgttggcattttgaaatcccaggccccacttcaaaactgttgaatcagaatctgcattgtaagaagatccccaaaagatctgcatgcacaagccttgaaagagaagagaagccatctaacattcctcacctaagatttgaagaatttcccacttatgcaagagtaggggtgtgatttctcaggcaggatatctaacagaaaacaacacttatgaagtgtttcctgtaggagctaagcaggtggccagaaaatggcaggctacaaaggagaagaatgactaggaacctgagcaaggagaaagtctcaaagacaaggaagtggctggcagtgtcagggactaccaggcagctgaaaaagctaggtgtgaacactatttcttggagttttcagcaagtaagaggttcatgatgatgcctcaaagaatttacagtggaaccagagccaagaagtcttattgtggtgagttgggaattagggaaagtgttatacagttgaccctcaaacagtgtgagggttcggggcgctgagccctaacctcaagtaagaggttcatgatgatgcaatcaaagaatttacactggaaccagagccaagaagtctttttttttttttttttttttttttgagacggagtttcgctctgtcgcccaggctggagtgcagtggcgcgatctcgactcactgcaagctccgcctcccgggttcacgccattctcctgcctcagcctcccgtgtagctgggactacaggcgcgcgccaccatgcccagctaatttttgtatttttagtagagacggggtttcaccgtgttagccaggatggtctcgatctcctgacctcgtgatccgcccgtctcggcctcccaaagtgctgggattacaggcgtgagccaccgcgcccggcagccaagaagtcttatggtggtgagttgagaagtagggaggtggaaataaggaatggagatgaagacatgaaaggaatttgagaaatgaggcaatagctagagaagaatataggaatacacagatccagcaacccagcaagggaagggctagattctgatttcatgagcaaattgcctactaattaaattcacaatatcagaggaaactgttggactcacttactgaataatagctgaaaagtatctttgctttatagagagatcactgtagatgaaagtcatcttccagtggtgagatattcttcagtgtcatctcttcatttttatttctaatttttcttaatttgaattatttcttctgataatgggaatgatgtggtaattttgtctctcctgtaaattattttaaagatttgtacgaactcctttggcaggcttgagtgtgttgtgacagcttggcttagatatgcattgaatgtcattgaattcaaactccttaccaacatagttagatagcccataggcattctacttgaccctttcaaggagatctggagatgcaattgtaggggaaaaaagaagaaaagaattcaagaagcaacaaagtgaaagataatttggcttgcagaagagaggtctttctatcacagtaataataatgccaattatatgtccatatatatatatacgcacacatatatatagtatatatatatacacatataactcagacataattctttcatagttctttcttttgtgcacagattcacttctgttataattacatacttatgtgacctatttgttagtaattgcttcagtttcttaaaagagcatcaccttgctgtgcaaagtgtgattgaagcctcaacatctcttgggagtttttttagaattttgaaatcccaggccccacttcagaactgttgaatcagaatccgccattgtaagacaatccccaagggatctgcacgcacgttgcagcttgagaagcactgcagtatcacacatatacacacatattcaacaccaaagagagagaaagaggtcataagctctcaggtggagactagttccatgtatatatgcatagagagaagaacaaactctaccttccagcaacgtaaaattctactcaatcatgtattcaccaaaaaagaaaaggctttctccatataatgtgtattattcatatattggcactcttcagagctcttcattccaccctaatgttatctttcttagataattcacatgacactttgttatcttccaataatttctgtcattgttataagcgaaattattcaggctttatctaagagagtaaatcaaacagtatgcctctctcattccaattctgcaatattttcattctagaatgtctaaaggagccttgaaagagaggagaagtcacctaaggccagctagaggggatatatagcagggaatggtggcaactccactcctcgtagcccagtggggttttttttttttccaatctgtatttgtatgtgagtatcacgtctatgccgattttatgtgtacatatgtaactcaaatctgttcattgtgctagttagaatcttatttccccctcttctactacactctaccctttctctttcccctcctttggcaaccaagacactgagttattaataagcagattggagcaaacattttgatgcactattgtttgatagatttgttggttcattcaataagcattaattgagcacttgctaagtgttaaacaatgtactaattgctagatttaaggatgaaaatgataaaacccttggcctctagagcctagagtgtagttggggagacaaatgggcaaattagtcacacgacaacatattccttgttaaaacagacagttgtgcataagtctgtatacccagactggagatgactctgtttccaatgttgccctgggaaacctcatgatcagtttaataatgatgtttggggtgagaggatactgagacagtttgcttctagcatagtaattacccatagaagtttggggtctttattcaaaagagtttacaggccacatgagccactgtcttgccttttataggatcacatctaagttccgtgtcatataatggccttggccttcttggctttctctgtgctctttgcctgccaataccctaattattgaagtactgtctcccgcagctcctcaaccatgagctgttcccgatcctcccagcagctatgtttctcctttcttcaaacctctttagctttttatttgtactttatttgtactaaattgtatttagagctttggagaacattcttcatagttgtaattagactgtaaagtcctgagaatgtatttttcatcttcgtagccccctgcagtatctagcagaatgcctttaaacaaatgggcagtaaataaatcccaacaaacttaaattaaatttctccaaattgcatatttaattttatagtggcatttactgataacatacattgaaataaaggccagagcataatcctctctgtttctgaatattatttatttaaatattaactttctaatccaattaggtctttcaatgacactttagatctaaatttatttttgcattgttttaaatgtcatcaaatgattcatctcttgtgttttttaatatttttggaacgaacgtgtgaaaatgagcaagtgtcatcagaatatgatgcttgggtttttttaattcaacatttctttgatcatatatttaaagactttttctcaattcctttctggatgtggcctcacaaatcatttcagaagtcaatccatttcaagatttttttttttttttttgcttttttcacttcacaggaagtcaagttcattctttaaaatgtagcaaatgattaagcaaattcaacgaatgatcttcatcaactccgaggtgtttttcccccttgaaaaatttaagttactattatttttttttctttttttttttttttgatacagagtctcactctgttacccaggctagagtgcagtggtgtgatctcggctcactgcaagctccacctcctgggttcacgccattctcctgcctcagcctcccgagcagctggtaccacaggcgcctgccaccatgtctggctaattttgtgcatttttagtagagatggggtttctccttgttagccaggatggtctcgatctcctgacctcgtgatccacccacctcggcctcccaaagtgctgggattacaggcgtgagccactgcgcccggccaattattattattttttttaaacttcacctatcataaatcttttaaaatttcacctatgataaacttcctctgtcatctggggaattacttaaatgcaatgatggccttcaagtatactaccaggcagcctatccaaatcatgaaacagaaaggctcatagaccaaattaaaatacttgaatcacagagtttattaaaatcacagtgagaagcaaacgggaaagatatgtgctaagttaacacgcttagaatagagtgtaagcagactgtgaagattagagtacttgaattctgcagtacacaacattatatgtcttgtctgtctctgtattgcatcagccttcccaattatggtgtgcttacaaggaccaaagttgacttcccaacaagggagtccaaaatgggtggtgcctgattcagtggcatgtggtttatcagagacacagagacaagaatgcatggccacagctgtaacttgccaaaatagcctgatgactagccatgtaattctcaggcagaagacttacggtgctggaataggtatcacctatggatgcctgaattaagaccttgtgaacattaagtgctcatgtgtatttatttgatcttgaatatttagtgcctcttgtatatttggtctcatgtgtatttagcatattatgaatatttagtacccaggtgcctcatgaatattgggtatcttttggtccttctatccctcactatctatgtttagtacacacatgctctgcttgctaactacttatcttctaattaacacattccaagagccaattatgtgtatctctttccactgagttcttcattcaatgacatcaagttagttgcttgaaatcagctattgtgagagcacttacaccacagaaattggcaaatgctacaattagcgccactgccctcccctagagccagttatttgacatttactagcattccactacttacatggcccttcatgctctcactccgtgtgaccactcaagccttatccctctttactgaactctacaatcaaataaaatatctttgtttcttgcttctggccctccatcaaatggctccctctcctaggaacaatctgtctctcctctatcacctttgtttagctagttaataatcccttttcagacagcacctcataaatagattcctgaacatcccaaaccggatctcctgcaccttcaatgtgctacttcagtacatttgtcttaccctttgccatatggtatttcaattgcccatgaatttgtattcctgtttagatcttaagctttgtgaggtctttttgtacttttttgtacttccgtatacctaccacataataaatatttaatgaaagcattaatgaataagtaagtgaatggagtgagtgaatgagtattcaattatgattcatttgtatcaaagtgataacatatacttacagggaaaaggccagagggggaaaaaataaaaaataataatatattttatgtatgaccttgtgtggggaaaggaacatagggccactgcctggcctgcttcttttatgcaaatcctaatgtaaaatatgatcaacgcctggctgggcagaaatacaaaaacccagtactagtgattctcccaaccagataccagctagtacagatcatagccagatttaactactgtgaagtggttaggttagaggtgacctataaggaaatgacgctaatgatcattagcatcatcttggaagcttaaaaaaatgccccagctgtaccccaagccaatgatatcagacttttgtggggaacccagatatcattgtttttaatctttaatgattccaatttagccaaagttgagtctcaacaaaccaagttcttcttactctcatattctcttcttctcgcatagataagaattaacagccagctcttctacatgtttcttagacacatatattgtttcagtggtaattcgttaacagtgcatatgtcagcaaagcatgactgaaaaaaatatctgctcccacacattctgatcccatcttgacactgcatagctgttggcgaaggcaatttcaacaatgaagaagtgggagaaatgactacattttatgtaaatatgtattcattgaaaatcaaaaggacatatgtaatgatattgtttaagattctaaatgaaggacaatacttaagagtcctctgtagtcaaatttctcagcagtaaaaaaacattgtcttttctttacaactattaaccatatggctgtgaaaatgttattctacaagcctttaagatttgaaatctgactttatgttaatacacagaatttaccacacaatcctgtatgatttctaagtagatttaaagagtagctattgctcaccttttcaacataatggtaatgatggtgcaatgtcaattacatgatactctcatgggcgtgattatatgattgttaacacactgaagtgcttatatagacatagatactgatttttatatgtacatatttaaaacaaacaaggacttaaaatggcctgtaaaagtctttctagtcagtctttctggttttggacagagaacaaataatcccttacagctgttaggttggtgcaaaagtaattgtggtctttgccattgcttttaatggtaaaaaaaacgcaattacttttgcaccaacctaatagttatctacttccatctttaacgggccctacccaagactgcatggtatataagtaagaaatgtaaatgaaaatctcaaatgctagatctgcccaggaggggaccactaatgagagaggaaatgttaacgtcccatatgaactaagctcagcttagcatttacccttcctgctattccgctagagcagtgcttctcaaaagttgacctgtaatggaatcttctgaatgcctttttaaaacgtagctggctgggccccatccccagagtttctgtgtcagttggtctgggatggggcctgagaatttgcatctctaacaagttctcaggggatgttgccggcccttgaatcacaacttaaaaacctctgctctgaagaaagggaaagctctctctgctggatttccccaagcctttttcagattttcaggagacttctgtgcggtagcttgcttccttctttccatactactactactaccactactactactacaaatagcaacctctagcatattttcagtactaaatacccagcactatatatacatcacaaaagtcccttgaggaaggtggtattatcatctccattctgcggataaggaaatagataagaaatttgctgaagatcgcagagccaaatgagactcaaacccatgtaacccatgtctgtttgactttaaagcccggaatcttaatttgttccagacaagctcattatgtgctctgatcttcaccactgaaatgttctgaatatgaggctgagggcagcagtgaggttggaaggagcagcccagaggagcaggcactgtgctggtagaatagtagtatggtggggcctgcactccctaataaaagaaggggacaatgactatttcctccttctccaaggtcgtgctgcctcccatttctctgtctgcctggtaagaagcagctctgggccatgtgtggtggctcacacttgtaatcccagtgctttgggaggctgaggcgggaggatctcttgagcccaggaaattaagaccaaccctagcaatctagtgggacttcatctctaataaaaataaaaaacttagctgggtgtggtggcacacacctataatcccaactactcaggaggctgaggtgggaggattgcttgagcttgggaagtcgaagctgcagtgagccgtggtctcaccactgcactccagcttgggcagcagggtgagaccctgtctccagaaaaacaaaaagcagcagctctgaaaagaggatctagcagtttctatatgcaggagagcatttgcgcaattgttcctggggttgaatctgagaaactcacagtgcacattcagatactatttacaatcttctaggaatagtataaatattgtggccagggcaccttcatattgtgaaacacaaaaagacttcagaccttagattatgtgtcgaaagttaggcaccaatgatttttttttccatttgttcttaagtggcaaatctttacattaacatttttggtacttgtctttagggaaatttcttctctgttctgaatgtatatattgtaattcctcatttacaattttgcctgcaaatgcaagtgagtacagatcatccagttatgaaaatgctctgagatttgagtctagctgtttcagctttaagagccctgacctagactttgaaactgacatggttttatatgtatgtggttggaattaaacccaaagcacatcttttaaaactctgaggaacttctgtgccacagctttcgctcagttggtgagattttactttgaaatttaagggatgagtctagtttatatgcaaagaaatgtagggagctttgcaaacccaatcaaatcctttgtgaacagtgtgtgcatctgtttattttgctgtcattttgagtccatgatcctgtatactgttttgtgggcacatattgagggtaatatcaaataccatgtagaacagatgctgcaggtatcctttccatgtcctcttagctttggggtggtagatgggcacatggaccaagcccaaagtgacagggtattaacaggagcaagactcaaccaataagggagagtagatgggtacaaatctcagctttctctcccctcactgggataattttgagatatattccaaagatcctcagagcatccccaacagcattgagccccagttccccagattagtaatctactcaataaatacctcttttttttttttttttcccgagatggagtctcactctgcaccctggctggagtgcagtggcacaatctcagctcactgcaacctccacctcccgagttcaagtgattctcctgcctcagcctcttgagtagctgggactacaggcatgcgccaccacacccaactaatttttgtatttttagtagagatggggtttcaccatttggccaggctggtctagaactcctgatctcaagtgatccgcccgccttggcctcccaaagtcctgggattacaggcatgagccaccacgcccagcccaataaagaactctggattgtttcttccttttcctctcctcctttcctgttccctacagtgtttcctaggatcacctcagtctgctgtatgggaaacccagactgagtcaccataacagacagaggcattgttactttaggactttagtggatatagttacatgggagagagagactgtgtatgtatatataacctttataatattaaaccatgctatactcaaattatttactggccaagatttccaatataaattggaaataaattggatataaatcaagaacagttaaaattggaaatagttaaaatacaaataaaatagctaaaattgggcaaaatacctgacccaatgctttaatatccgattgcataattaaacgagtaaagaggaaaggaaattattagcaactctatatttaaatgcaactgacatccaaggaagtcatgaagaaaactctttgtgttgataaactgaaggcctcttctagcagacttctgtgtttattgttctgttgctgactattttattccaaacaaatgaacttgcttgtcattataccccacccttccctagtacagggcccccattctttgaaacagtaactcattcagttccaaggagaatatgaaaagggagggtaatatataaaagaactgaaatgaaaagtggcctaagtgtggcacatttccattgtggattccatggcaatggagaattgatggcagagcatggtgagagatgtgaagcatcaattggctgtatctccagggaattcctgaagttcagttgccaccctggagggtggcaaatgctctctctcaccttccttgagttattgcttagatgactcaaaacaaaaaactgatgagctataaatgggctgtattatttgtttttacctgctgagtagttcagatatttcaaaataatctcaaacttaacctatggtgtggtttctgtgttaaacaaaataccgtaacttttagttgaaaatactgtgtaagcccacacaatctcttgttcacagataatcttgttgtcaaacattcatgatgacaaaaactcataaacgattcttttaaatatcaagaataacttatgctgtaagtcataatttcataagcatgaatttatgaatgtgttttgtgtttgcaattttcatttaggttgtcttaaaatcatgcgttttagcttaacttaggagaaatatatcttttgtgacaacataggatattcagagaaacgtgaaaactaggtgatgtgttttatgaaagaaggcataaagtatatcaagcataagaactttgaattctatttgtgttttttgtggctttagaaaagattgttctgggaatagagaattccatttgggaaacctagcacatacacagtagcagagttaaaatactgacttggagggttcatttgaagaattctatagaatttttgcatgttgggaataggtttatattcttaaacattgcactcagggtttctattcaaagcaaaaataactttgcatagaccttggccattctttcacattctaaagtaatccatttttttttttcagggtagttgttctcagtcctgattttctgataattcagatcatctttaatttacaccaaaaacttttagaagagtcagataataatttaacataaaatgtaaatgactgaaatatacattttttaaaggagcagatatggaggggtccaatgtacttaactatttgctctctttgtctccttgcattcacgggaatgtttctatgtagttttctaatttcacacaatttcaataatccataccctcctcatttttatgggccttcatgatactaaaaatgttaccagaaattattttgtgttagtctctttgtttagcacattcatacataagttttaacatttaactggcatatttttaaagtaatacatgttttttttttaaaaaaaatcagttatgtttgtgtgtgtgcatattttcttttgtggccaaatgttgcacgccctagtccttctatttaaacaatgagtttacataacaaatgttacatgataaacatgaagacatttagtttgaaaaaaaatgattttctagtttactcatttaaaaaaagctgaagtaaccgggaagaggagtggcagaacatattagtctttttcataatgccatcattaaacaaagatacttaatttccaggcctggtgcagtggcgcagcctgtaatcccagtactttgggaggctgaggagggcagatcacttgaggtcaggagttcgagaccagctttgccaatatggtgaaaccctgtctcaaaaaaaaaaaaaaaagaaaaagaaaaagctacataatttccaaaatgacttcagtgggacctgaggtgagggaataaaggctctggagtaatttcactctctattcctctcctaattttttttctgttcctttataacaacattttcactacttttgagcttgggagttgaggaatcatgaccagaagaaaaggaaagacgggaaagatgttcaagggtgaggatgcttaagaatgacctggcaagcttatgaaaatgcagttgtctggatcccaccacagagattctgatttagcaggtctgtggcaaggcctgcgattctgcattgctaaccagctcccaggtgatgacactcatgctggcaacctatgaaccattgagtggcactgttccagggggcagggcaatgagaaattgaagtcaaaagccccaagacctggtgctacgaaaatactctggttccttccctctcaactgatttacttgtcggtgtgattttgcaaaaatccctgaacttcttaaatcccagttacctcacctgaaaagtatgagtgttgctccagatctggaggctttcagaccatgcaaatcgaattcaaaccatgcaaaccattcaagtcattctagaaagttctgcaaggtgcctcagaggccaaagggagagatgggaagagggattgaatgggctctttccaaggttccctaacccacttgaatactttcatcttttatctctttcatatattccacttttgagtatggtttcatttagaaaataggattttataccaacagatttaaagaaaaactccaagtctgaaaatgactcatttatttaaaactgtatagaacaaagacatttagtgcacaattccaaaaattctctgatccttccacagcatgcccagtatgctgcaagagtgccagcaaacacatgcttactgctcacaaatgtgaaatttaaccccatgcactaggaggtccctagtgtggggtggttttagctaaccagactaagagagtacagggcaacatcgagcctttctctgcggtcatgtctgattcattaaaaatccagctttccccgaagatatattaattaccttctgtttcagaatttgtttttagagcctaattcttaattatatctccagccattgtgtgatttgaccattttggaactaaaaagttatcctatgaaattccacctccaactattgccacactgttagtttgtctatttcatacaccatgccaatcttagcgtggtgctagcatttcattataaccagctttcatttttaataagaccatgtgtatatgaaattgtagacttcagtctttgtatgaattgaaagctattaatcttcccagggttaggttatgttaaacagattgtaatgttcttctttttattatgttatttaaatccccttcatttcatactgcaccaatacatttctactatcttggaataaattaattccagttacgtgatggaaaattttagtgtaaaaatataacctgcagtataattttttctgtcagaataccaactagaactggtatgtttcattctaattggaaatttgagttatcgctttgatttttaacagtgggaaaggaaaatgaagattgatatctttcaatagccgttcattcattcttcattccttcattcattcacgtattaagaatagtctatgtgctaagaacagaaagagtgttagagatatgaagattaataagaccagatccctgcctgcaggcatttcctattctatgtcatagatagggggctattctgtttagaggtaaagcatgacccacattgcctctgacaagaagcataatgtctgtagcagctaactgctggagacaggaggctagagggctgccctggtaattggtattcaagtcttcaagaaaggaaaccagctattccaaaatcagtgggcaagaggaagttgtaaagttaagtgaaatgactaaaatatgaataactaaaggttggaatctggtagaaggagaggagagcatcggtcagcaccttagtttgggaaggtggtgtggccatagtaggctttatttagaaagaagcaattcttaggtaccagctaggtttcagttccttaaggggagaaaactggcaaaatataggcaggtttccagggtgcaaagccacgttctagcttcagctcaggcaaggccctggggtatgaatcaccaccagagtagcccagccaaaatgactaagggatctaagctggttgctaatgaaagaggttgcagctcaaggcagctctgctgacgcccactggatactgggattacattgatttaacacatggaaaccacttaatatggtatgtggcacaacacaattaagtactcataaatatttgcagataatgctgctgccattgctgtttttgtcgttagaagactcgggaaaatcatctaatacaggaatccatctgttggcggggcttgggcttctaatatttgactggttgatttttgtcgacccaatcttaacaatattatacacagccattacttcaggaaaggcagttgtaaagaatggtataaatttcctgtaacttgactgccacattctagctgagtcacctctatatacctcagtttctttgtatccgcagtgaagattaatgacctcatagggttgttattagaatgaagtgaattactacactggacttatttaggacagtaactcgcacatagtgagtgctcaaggaaatctcagaccctgcctgctagtggagggtccagctcctgatacatttgggggcaggtttaaggagttcattgatttagagctgtaagggctgatctttcaccctgcatgtcttcagcaactgtggctggtaaagtccagagcagtcaaaggctgacaaatccttgttagaaatcacaaatgcccattctcacaacttctgtggtgttttccatcctttccctagaatactttctttttaaggcaaaggaaagaataatcactgcagatagcacacagtatttttttgcaacatattttcaaaaattatgatgagaaaagtgtatcattcctgtgaagaaacagcataaggaaaatgatttgagaaagaaacatggttcttaaactgaaacaagtgtcagaaggaatcccagaaggcagaaggaaatatagtaatcatgatgaagtctagagctcacaccggttaacagaatggcagcagcgatattcatctcacgcctcttccatgctgtccctgagtgagcttctgctgaattgcctggctggtgaggattggtttcagcagcagaaggaatgggctgccagctgaaggctctggttctgatcctgggtagggtcagagaaagcaagatgtgaccatcacttttgaccttggtcttgaatttgattccatggaacaacgatattttacaaacccagttgaaggtttatccctttttctattcaacacagggagagtccttagagccccaggaagacttagccctttttcattctaagagtaaaccacatctaggtttccagagatgaaaagaccaggctctgatcttccttctggaagcccttgcctattcaacaagcatgagtattaaatgctattgccttggaatcataattcagttttcacagtttgggctatgtcagaaccattcttgtcaaccccctgttttctgagaacccgaaacctgcttgtttagaattttagaatctacttgactcttacaggggagaaaagatctcttttctcacccatcgctaggttcatggctgaggcacctataatgaaggacaaatcaacaacataaaagcatgcgaatttatttaatataagtttcacatgacacaggagccttcagaaatgacccaaagaatcagggaaaagtgtgtatttttatgctctgatttgaggaaaagtagatgtccagtatgactggacaaaggggaatggtaataaactggggtgaccacagcaaggcctgtttctgcagaacctcctgtgtccctgtgttttcagaggtaaaaattttcctttccttccagtatagtaagggcacctctggtatgatagtctcatgacctgcttcaggggagaagggggaaggggaaggtgagagtgaccatcctgcttctgctgtcttctcaaataccaagctgccatattgtggattttggagtagcgtaacttgaatccttttttttttttttttttgagacggagtctcaccctgtaacccaggctggagtgcaatggcacaatctcggctcactacaacctccacctcccaagttcaagtgattctcctgcctcagcctcccgagtaactgggattacaggcacatgccaccatgcctggcaaattttttgtatctttagtagagatggggtttcaccatgttagccggactggtcttgaactcctgacctcgtggtccgcccacttcggcctcccaaagtgctgagccaccgcacccagccgcatagcttgaatcttatcaataccttaaccaaatgactctgacagttttcctcttcttatctaaattcttgagggtcacccacacttcccaatgtcttttgaaacttgacctcttttctgctgaattgaggaagatacctgatttctttaacctcaccaaattcctacttcttactgttgttcattgctggctgaaaatttactttggcgagttcaccaagaacatacttatcggttcactgtttatatttgcactcaagataacacttgaggccctgctactcaaagaatttagtgacaactttcttcatcactctcatatcttatctgtcatcaagtctttttttcctcgtaaaaatgcttttagctctttaagtatgtttcatatctataatagctaagataggctaacagctataatatattaaacatccaccaaatggactattaaaatgacttaaacaaaatagaaatgtatttctttctcatgtaaacagtctaaggtgaattcatgttagttggtgttggatgtgtgtgtgggaagggaggggtgacacccacataattattcaagaatacaggccaggccaggtgcagtggctcacacctgtaatcccagcactttgggaggccaaggtgggcggatcacctgaggtcaggagctcgagaccatcctggccaacatgatgaaaccccatctctactaaaaatacaaaaaatagctaggagtggtggtgggcacctgtaatcccagctacttgggaggctgaagcaggagaatcacttgaagccgggaggcggaggttgcagtgagacaagatcatgccactgcactccagcctggcgacagagcaagactctatctaaaaaaaataaaataaaataaaaataaaaaataaaaaataaattaaaaaaaaaacaggccagcaagggtcttccatctgcaatagccaattgccgaggttgccctcctgaagatattcagccagcccaaaggggaatgagctagaggactgcacacggaggcgtcccatgtcctttgactcaaccttctactggctagaactctgccctgtggccacatgtaacagcagaggggctggaaaatgaagtctagctagatacctaaaaagaagcagagaaaggtttcaagagcatttagcaaccatatccaccttattcatgccctgccctctattcgcagtggccccgcagcactgctcaactagcttgctgcattggcctcttatctcttatctattgccttagatccatctaaatgctctgctactcttatgcctggaatatgttttcaagatgtgactaatcctctcacagcttgaaggataaaaggtcaaactgctctggtgaatgcatgatgcctggtcacctctgtagccccatcttccctgacactttcacagacagtattccctttactccaacctgtgggagtattttctaattcacaataatagcaggaaatacaatgtggaccagacacagttctgagcagtatattaactcatgcatttcttacgataactttataaggttgacagtagtagtatccctatttcacagagaaggaaagagatacagataagtaatttacatatgatctcacagatagtaagtggtacagcttgagtgcatatgactcaaagggtagaggttctagattcttaatcactgtattgtactacttctcccaatgttatcgtacatgccattccgtcttcctggaatacccttcgtctttcttcatctaacttccactcaaactttaaggatcaatttaagcatgccttattttaggtagccatggttgacatcagcctaatttaattgctactcatctatgtccccatagcgtcctttgcattcctctatatctctctgctatagcagtaaatgtaccaccattccgtaaaatccttaagggaatgtttagttttatgttcccaatgccagcacaatgtccagaacagtgttgtcccatagaaatgagagccacctatgtaatcttaagtattctagtagccacgttctttaaaagtagaagtgaaactaatattttattgaccctgatatatccaacatattattatttcaatatgtaatcaataaaaagtattaataaaatttgctttttccattctaagtctttgaaatctggcatgtgtctttcaattgcatcccatctcaatttggacaccgtattttcattgaaaatatttggtctcacctgcacacgtatgtttattgcggcactatttacagtagcaaagacttggaaccaacccaaatgtccatcaatgatagaccggattaagaaaatgtggcacatatatatcatggaatactatgcagccataaagaggatgagttcaagtcctttgtagggacgtggatgaagctggaaaccatcattctgagcaaactatcacaaggacagaaaaccaaacaccacatgttcttactcacaggcgggaattgagcaatgagaacacttggacacagggtggggaacatcacacaccagggcctgtcgtggggtggggggaggggggagggatagcgttaggagatatacctaatgtaaatgacgagttaatgggtgcagcacaccaacatggcacatgtatacatatgtaacaaacccgcacgttgtgcacatgtgccctagaacttaaagtataataaaaaaaaaagaaaatatttggtctctatttacatttcataaactttatagttgaaaaaagaagattcacattcctaagttgttccaaacatacacaaaagtttttcaataactgaaccaagagtcaatttttaaatttatatttaaatttaataaaatggaataaaaatttgttaaacttcagtctctccgtctcactagcctgatttcaattgctcggtagctacctacagccagtggctcctgtgttagacagagcagcacagccctagaacacagtagatcctaaatcgatgtttattgaagaaattaatcaatgacagtgtagaaaatttgcagtgattatgtcagaatcaatagttctccacccattttctcccacactctcaaaagggccaagttttatatcaccaaatgatattcctcttacttctttctgagcagaaacagttttggaaattaagatctttttcaaattttccagactcggcattttagcagcgtttctatttgtaccaacaatgcctttctacctattttccttgcttcttaataagttaactttgtgcgaaggtcattttgtaggtcagtgtaatattgtgcattaagggcttctaagttttctggtattataagaactccttggtttccttctacttttcagaatggaaaatcctcagagcaattttcatctaaaagtgctgcatttaggttgtttcacaattccccaaccctgagtcaaatataggttggtgtatgagcagcagtgtctcttggctaatcaagagcgtctccttttgctacgctcagtgttagagaaatggagaaagtcagctgggtttagagattaggtgagagactcaggcatatcctttgataagtcataaatcatttcctgtttagaaaagcacatgtttagacacccataaaatctccaaatgaagggtgttttacttttccttcaaaatctcactgggaaaaggtacttctgactttccaagtgaataaaaataatgactcctgattaccatgtatgtttaaactgatttgcaaagcaagtgaaaaagagtctagtgagtagtgataagcatcttttagacatcagaagatgtactgatttaaaggtccgtatcattttataactagtatctattgagattcaaatggttattactctgtgtgaatctgtcttttctaattgtttttacttattttagaatatcgatttgtgaatattaaattcctaagttttccagcaatccagtgtttgttttggatatccagcctggatgcagaatagctgcagaaagttatcacaaattgatctctatattctgtttccgagtggcaattgtcaaaaatttggggtcatcggctacccctcccacccctaagaagttccttgtacttcctctttcaaaacactcacatcattgttcagtgcctcacttctctactaaaatgtaaccaaccacaaagatagggactatgtctttcctgtttactggtggattctcagtatctagcaccatgaccaatgttaatagacgttgaatcaattccagttgttacctcttcacactgggacaaaagtccttgcaagtattctgctgccatttgtatagattcaagccaaatatgtctcaaaacgatattacagatgatctcttcgttgttcctctgacaatttctttcccccctgcattgcttaacttgattgacaatgacccctactacttataacatgtgccttttaggtagtgcacttggcactacattttatgtgatagttttatgatgctaaagactatttgctgtgatgatgctgtgttctcacatggcatatccagatttatttatgctggtgaccaaaggcaggtagttaaccttgaaaataggttaaaatttgaaaggcagcaaatcttagggctagaatttataatttatctttaaggaatcttgaaaccaggtgtgaaggaagggacgtaggctagaagtacagaaacctgggttctgctccagcactgatgttaagagcaagttgcattgcttttctggaccttaattttctcttctggaaaatgaatagattaactggaacaaggaaggaaaatacgtgaatggcttccgtttctgtctcgtttacccctgaaagacatggctagtcagtcagctctgtatcagagcacttctcaaggcaatgctccaggtagctaccactcactaatgagagttagcacataggtaaaacctctttgtcatctctaggctacttcatgtttaagatactctccagctttaaaattctaataactctattagactgaaatttaagaatacgagaataatcatccctcaccatgaagagagagtctgaggaaaaaataatgagaacgaataacccttctcttttactacaattcaggactgccatgaagagccgtccagattgtgaaacatacaactcatgatgtgaatggtacttctttgtttttctcggtgtacaacttgcacagctgttcatggccctctgcttccacaaattcatttctaaatagctgtacctcagttctttgacttctagtatgtctaatttaatacacatttctagatttacgatatataagaaatatctccatgaaggaaaaatgtaatagcccatgcttttcattataatagaattttatgaaacaatgtcttttaaaaacagaaacatatgtactactacttcgcaggacattagcccttgtatataaatcaataatacaaaaaattcaaattaccaaggattagaaaagactgctgtgggatatcttctggtgcaagcatacagttatttatccatttctttcatgaatatttattgatgttccaaacattaggctagacactagagacacatcaataaataaaggaaataggtttgatctctatcttctttgatctgtagtttagtgggggaggaaggaaattaaacaagtaactactacaggttgaacatccctgatccaaaaacctgaaatccaaatgttccaaattccaaaactgtttgaatgctgacatgacatcacaaatggaaaactccacttctgacctcatgtgacaagtcacagtgaaaatgcaggcacaccacatagagtttattcagcatccccaagggaagaaagatcctctcagcccccgttagctgtgatatatcttttccacccacacccagattccatcatacaagcaaacccacaaaaggtacgaaaaatggcacatgtgcgggctagacgcgacaacggcaggtaccctacaatgtccagcatggggccaaaacctacgtgcattaatcactgtgtttgctggtatattctctggtggtgtcaagatattgttgaaaatgccctaaaggcctgcatgatatccatagggtaatgcaaatattccaaaacctgaaatttgaaatactttcagtcgcaagtattttggatatgagatattcaacctatagatggtaagggtattactatgatagtgctacgggtgtacatcaaggtaattgaccctggcttggcaggatgcagaaggctttcccaaggaagccttacctcagctgagacctgaagagaagcaggagttagacaggtcaagttggggatttggaggaggtggagtcccagcagatggaatactatgcataaaggcctggaagtgagaaagtcatgtcatgttatttcaagggactagaggaagcttagcaaactggaggcaagaagatagcttcagcacactattgaaattgtccaggtgagtaatgatgatagtgtaactaagttgtgatacctaggtatgtgagctgaacctatggagaaatgttctaggctagagaatctttaattggatatttaattatcagtatatacgtaattaaaaccttgcaagggtttgaaatggttcagagtaaagttcgtagatgagaagagggcctaggagtgaacccaggaaaatggcaaagtttcaggggtaaataaagaaaaataagctttcagtggagacagggaaatttgcagttcagtagataggagacagactaggttcgtgtgatgtcacagaatccaagggaagagaggttttcaagaaaaagtaacatttagaggtgtcaaatactacaaaagcatcatgaaagataagaccaaaatatatcctattaatttagcaacaaggaaggtattgacaacctttatgcaagtgatttcagtgttgattatggagaactcagtaattacttggtggtaactaaagaaccaagattgcagtacgttcaggcatgattgagaattgagaaagtgggggagcaagtgtaaaacaattattttaagacttttggctgcgatgggaagagagaaagggccatagtagcagaagatggatgtaggggcaggaagaacacactcttaaaagggtagtgacttacacatgtttaaatggcaatgagaagaagatggtagagagggagaggttgaggatgcaggagaaattagagataatcaatagcacaggtacttgagaaggcagaaagatgaaatttagaaattagcttcagataggaaggaaagtacagcttctattacaacatcaggggagaagggaaggaggatgggcatagctactggtagttttgtaagtttggtgaaaggttaagtaggattgttgtattggatttattttttattgaagtggaagctgcagctaaatgcccagtgatgaggaaggtgttggagtctgagatttaaggtgagtggcaatttgaaatagctgctctaggatcctatttaacagagaaaatgttgagtacacaatcagtgagcagttttaagtccactctattctgtttgcagtttcaagtacctttcattgcttctaagtttatgaaaactggttcacaatcttcttgtgcttcttatttctacctcttttccttctgttttctcacctccccagtttaaacagtcccgaattttttacaattaaatatacagcaactgccatgaaatctactgataaaagatactgcaaaatcagtttgggattgggttcattagcttacttattattatcaatcctaggccactaagcaaccttgcataaaatgcataaaatgaggagattctagtggaggatagttttcaattatctcattaatttcaggccatgtgactagtccaaatagatattataggccaagaagagcctatcttgagattttaactcccaggataggttttctacctgatcaaaagaatctaataactattcaatctcttcttaaatggtttggttttctgtgcaaacagttttacccttttagctgattttctaggtgttaaattaagaaaattctctcagatacttgttcatcatgtactaggatccctgatgtgttcagagttgtccaactttcaaagggctttgcattcagagtacctaatctaaaccctgatatcattcttttataacagaaaaccccggattagactgggacagtgtctgtcatgttcatcactgcatctccctcagtatttgtagaatgaatgaagggacaatggcaaactatagtcctaccatcacacttttggtagtgaggagaactgctgtaacttggaagattggagggggaaaaggtggctaaaacaatcatacagtaaactgggctgctatcaagagaaaccatttgtcaattttggcttttgttgccattgcttttggtgttttggacatgaagtccttgcccacgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatattcttccatttgtttgtgtcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgattttagtacattgattttgtatcctgagactttgctgaagttgcttatcagcttaaggagattttgggctgagacgatggggttttctagataaacaatcatgtcgtctgcaaacagggacaatttgacttcctcttttcctaattgaataccctttatttccttctcctgcctgattgccctggccagaacttccaacactatgttgaataggagtggtgagagagggcatccctgtcttgtgccagtttttaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggagttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaaatattgattattgccacaatttcagagcctgttattggtctattcagagattcaacttcttcctggtttagtcttgggagagtgtatgtgtcgaggaatgtatccatttcttctagattttctagtttatttgcatagaggtgtttgtagtattctctgatggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtaggcatttagtgctataaatttccctctacacactgctttgaatgcgtcccagagattctggtatgtggtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaagtatgtggtcaattttggaataggtgtggtgtggtgctgaaaaaaatgtatattctgttgatttggggtggagagttctgtagatgtctattaggtctccttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcataaatatttaggatagttagctcctcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacgtgagatgggtttcctgaatacagcacactgatgggtcttgactctttatccaacttgccagtctgtgtcttttaattgcagaatttagtccatttatatttaaagttaatattgttatgtgtgaatttgatcctgtcattatgatgttagctggtgattttgctcattagttgatgcagtttcttcctagtctcgatggtctttacattttggcatgattttgcagcggctggtaccggttgttcctttccatgtttagcgcttccttcaggagctcttttagggcaggcctggtggtgacaaaatctctcagcatttgcttgtctataaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgggctttcctttgagggtaactcgacctttctctctggctgcccttaacattttttccttcatttcaacttggtgaatctgacaattatgtgtcttggagttgctcttctcgaggagtatctttgtggcgttctctgtatttcctgaatctgaacgttggcctgccttactagattggggaagttctcctggataatatcctgcagagtgttttccaacttggttccattctccacatcactttcaggtacaccaatcagacgtagatttggtcttttcacatagtcccatatttcttggaggctttgctcatttctttttattcttttttctctaaacttcccttctcgcttcatttcattcatttcatcttccattgctgataccctttcttccagttgatcgcatcggctcctgaggcttctgcattcttcacgtagttctcgagccttggttttcagctccatcagctcctttaagcacttctctgtattcgttattctagttatacattcttctaaatttttttcaaagtttttcaaaagcaatggcaacaaaagccaaaattgacaaatgggatctaattaaactcaagagcttctgcacagcaaaagaaactaccatcagagtgaacaggcaacctacaacatgggagaaaatttccgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaagaaatgctcatcatcactggccatcagagaaatgcaaatcaaaaccactatgagatatcatctcacaccagttagaatggcaatcattaaaaagtcaggaaacaacaggtgctggagaggatgtggagaaataggaacactcttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcactattcacaatagcaaagacttggaaccaacccaaatgtccaacaatgatagactggattaagaaaatgtggcacatatccaccatggaatactatgcagccataaaaaatgatgagttcatgtccgttgtagggacatggatgaaattggaaaccatcattctcagtaaactatcgcaagaacaaaaaaccaaacaccgcatattctcactcataggtgggaattgaacaatgagatcacatggacacaggaaggggaatatcacactctggggactgtggtggggtcgggggaggggggagggatagcattgggagatatacctaatgctagatgacacgttagtgggtgcagcgcaccagcatggcacatgtatacatatgtaactaacctgcacaatgtgcacatgtaccctaaaacttagagtataataaaaaaaaaaaaaaaattaaaaaaaaaaaaaaaaaaaaaagagaaaccagtgctctattatctaggtatataccaaggttacccactgcttgactctcattattagccttctttgatgttctctggtacttgatgtctttcataactaatcaatgtattaatgtatccaatcatttactcgataactttattgaaagcaaaagcagttgcataccagctatcaagctggaagtgggagatacagccgcagacaaggcagatatggtcccagcccttaggagctcccagagtagcaggaggtttccccttccagtgtcttctctctgcttttcttcaaaaggaaaaggctgatgtgtataatataccatatctctttgaagttctctgattatggattttaggtttaaaccagttcttcatccatgactttataaattgaaaatccaggattttgctgtgttgttgtgttcttgttttgttttgatgtccctgttttctctagatacagttagaaatgtctaggaagaaatttttggttagtatgggagccccacaaagccatttttttaaacataaaatctgtattacatatcaggtatgaaatacagggggaatgaatcatttctccgtaaaggaaaatttaaagtaaatttcaggaaagtgaattctttcccgtttgcattaccgacagatgcagaaactttaatcgtcatttgctaagagggatatggcagataatacacaatagatgtcgtagcaacattcactcgcattctttttttttttttttaaagaaatctttctttcaagaagctattctaggatctttctcatgacagtgtcctagttcttatctttgctacacacaggctcacaaagtgttttctttgaagggcattttgttattggccctcttttcatttttcttttccgtagcaaacagaaccgaaggtgtttactccccacggtgagagggcacctgggtgcacaaacagtggtgtgaaccactggcctttctctgctttccgttccctgaatgtaagaaacaggtgcagtgatcaattcactgcgtgcagtgaaccccaggcagaaagagaacgtcgtgtcacagaccttttgttacttggagagaatgagcgggaagaaaggctgcctctgctgctactgagacccttttgcccattttattgactgctataggttcatctatcctaatttgtctccggctgtcccagtttatccctgttattcttgtgttactttactttactatattttattttattttattttatttattttagagacagagtcttgctctgtcacccaggctggagtggagtggcatgatcatagctcactgcagcctcaaactcctgagctcaagcaatcctcctccttcagcctactgagtagccaggattatagctgtgcaccactatgcccacctaattttttttttttttgaaatggagtctcgctctgtcacccaagctgcagtgcagtggtgcgatctcggctcactgcaacctccacctcccgggttcaagcgattctcctgcctcagcctcctgagtagctgggattacaggtgcccaccaccatgccctgctaatttttgtatttttagtagagacagagtttcgccatgttggccaggctgttctcaaactcctttaactgtttttttatttttatttttaatttttaaaacatattgtagagataagagtcatgctacattgcccaggctgatctcaaactcctggcttcaagcaatactcctacctcggcctcccaaagcacctggattacaggcatgagccagtgtgcctgaccctgtgtgattattattagcatcctggacactctcaaaagtgttcaggtttggacaatgaactataggatcaccctaattacatgagattaagagtagagaccttgaccaccagaaatggtcaatactcaccatatattttcttcctgatgttagaacctggtacttttgggaaatgaaattgtacatgagatatatgcagaatgggcgaagggagcgaaaagatttaaaaaattaagctcgatttattgagcgcctcgagtgcgctcagtgctgttccaagtgctgacagcagagaggtaagttctgttctccagtgttcacctcacacgtgcaagccaggtttgaaaacacactgtctttccttagtatccctccacccctccatgtgactatacgtatgtatcaagtttgtgatatttcacttctgggcttcttttcatttggaaatttaatgtcagtgtatcatgttttaattaataggacatcatgttatgaaactgttgaatcgaatattttccctaggcatcaaattacttgtcagtggaaatttgacatctagatatgagggacaaaagagatgagaaaaataatagtaaagtgttcctaaaggatgctggtatactgtttaggtattttaatgcactgttacaacctaaagtgtcttgtaaagtatgttctttagaaataaaataaataaaacaagacatctctccataggtacaaatccacttgccttcctcaattcctatccttctgtgatgggaaatctctgctgtgacaaagaaccatgttaagaaaaccataaagttgtattgtttgtagatttttttaatgactaaaggaagatattgcaagtagtagaaacaaatagaggaggtggccctgaaggtcaatataacggagttcactgcagaaaagagaaactactctaggtacgttagacacatatcaaagttttggaaaggctaaagtagcaggttttagacttggcttcgaggacagatttctaaaactatatagaactgatccaataagaaactaccatctccggggtaccactgaagcaatgatttcaagaacatactttgtaaataggaactaggaaccaggaggttgaaatctagacgctaccacttttgaagctgctgttagcaactgcccttctccagccaggaagctggagaaagaactttggaactctgatgtaggaaatctcatgtttctttgactaagctcgccaacagaaatagccaaaaggggcagaaaggtgacctatgcctcacttccactttccagatctctcacaagtatacacatttggcaaaacgttgccagatttagcaaataaaaataatgcatgcaacatacttaacactaaataaaaaaagattgtgtagaaaatttaaatttaactgggtgccttgtattttatctgacaaccctaacttattatatcctaattcataatcagaacactagctgcatggaagtctggcaaatacagtttttaatttccaacctgtccaactggaaggatggtaagtagatttaggtgagccagttcacagtattaaccaaagtagattgcctaccaagaatagctaaagcctttctgcccccagacgcttatgctaccatctgaatatttttactttgcattcttatattcttggaaatcctatcaatctgtgattcagattggtttggtttaactcagcttccccttttttttggagacagggtcataccctgtcacccaggctggagtgcagtggcacaatcatggctcactgcaacttcgacatccctgggctcaggtgatcctccctcccacctcagcctcccaagtggctgggactacaggcacgtgccaccacaccccgctactttttgtattttctgtagaaacagagtttcgccacattgcctaagctggtctcagattcctgggctgaagtgatccacccaccttggcctgacaacgtgctggaattacagatgtgagccaccatgcccagcccctctttttaaaatataaaaatctcccagaatgtgaaagttgtcagtctatactttgggaataagattttcaacagatagaagagaatgaggattaaaacataaggaagtttgggagtagaaaatatgggcaccagaaggtggaaggagagagcagatgcccatttatatatctcctttgttgggtgttggacaaatccaggtcttaaaataggaagtatttcttttccgtacttcttgaatctttcatatcccaaaagatgcatatttcccaaatcatataacccaaagtcatgctatcaaaatgatataaatcatccatggtataggttaaatagctatatatgtatatgctggtctgagacatgtatatgactattgtgtccatggaaatttgagtttggggttctggaccatttatttgcaagtgatttttggttagagaactctttgtaagttggggattgcttttacttattttatgagtaaagatgtcaaaaggatgactgctaaatttgcactgtgttaattcactatttagtgagaagaaatattagactagctatgaaaagtaaaactgcctctccaaaaagtcaaagctgatgaaaaacagtcatacaagcacaatgccgctcttcggaaacatggaaacactttttccttcccaattttccctcagattttctcttccgcatttaaaacacttgggtggttcaagtttctaggctaccactgattgtaacagcaaacagtagcaactggaagcagtgggatgttgggagaagtaatagaggtagctgctacccaagttatcctggaggattttccatggcaatgaaatcaggtagtagaagcttggctaactgagtgtaagcaaacagttctactgagaatggtgttgtcttttcaatccgtttatctgtgatggtgatagtgtgaaacaggggaattttatccaaggtttaaggaaggttatttggttaaaagaggatattgttacagtgaagtcaaactttccattaactttttgctgtaacaacagattgaacgtagcatttcaccgtcaacgagtaaagtgaaatttacagattaacttatgtgcctcttttaaaatatatcagatttctaaattgcttttatttcagaggtatgggaggttcactttctctttgaaagtgtacattatttttctagtgtcttacatctgcctacaaagatgttattttacttgaaagcacagtaactatttgatgagaatttgtcagcatcagtaaattaaagaccctcaaatgatttctactaattatagtttaattccgtacatttaatgatattttaaaacacatgagttatttcataactcccaacatcacaaggataaattttattctacaaacaaaatattgtgctaaatgaaatagttcatttaggcaaagaaaggagcacagaaaattagtggaactctctgctgtaagtaacgtagacattacatggcatattgagtctccatgaatattgtcatgttatgttttaaaaaggtgatcgaacatatggcatttaaaagttccaagtcctcttttaaatgcttcagaatctattatttaatgatcatcttggatctcaaaactgatcttttgaaagattttattcgccccatgtgttaatatgatttccctgtcatatgatatgattatctatcaatacttaaaaccagcagccaagtaaaaaatcagttcatatcatttaatgaatactatgagtcaggatctgggtaggcaagctattttcgggtttgagtagttccaaagcttaaaaatcttatattgattttacagtgaagaagaaatagtcttagctactttggaggtttcaaacattgactactcaaggagtatttccttgctttctcaggcaccaggcagtttttcaggagcaagcattcatccattcagggaattgtaacctgtagtttccacttttctagcaatcacacttaaaaccatgagagtaggccataggacataaggagctcagcttctcagggcaagcacatcctttcagctttcacctgtccgtttgttagtgttcacttccgtgctcaaggagtttcttgttgcctctgagttctaagagacagaacgaagggagaagggtgcagaagtctaacgcatgttcatggacttatctctccaataaagagcttgttttatcttcttttatttatttattttttctaatgaagccattagcctcaaacaaagccatggaatcttatcagagtgaaaccggggtcattccataggctggctgagtgagagctccatggcacgatgatgtatggtcactgcacaacaacgcctttgccacaacacatgtgccttttaattacactttaaatctcatttgaagagatgttatcattatggaaattgctctgtaaatgtgcccaggatgagacccaataaaagtttgctgagaagaattgaagacagaggagatgaatcagcagctaaaacattaccatcagacagaattttcttggctgtaggcaaaacagcccatgcaataacagaaaatcttcattgactcagaggcgtattttccctagattattatggggcactcctgcctgtagcactatcacttctttgataagctgaaggaagcgttctgctctccagctcagcgggcctttttctccccaacctcagagccatcatttgaatttatagttgccaaaatgaataatacagtattgcccttgtgttcctgacttcatgcatgcatgcagagcggggttaaggttctttaaatgaaagattgccttctattcatgcaataaagaacacctctgcttcctttccagggtcatttaaaaataactataccgctgggctatggaaagcacataagaaagattcttagggtaaagtcaaaatgctcttttctctacaacaggcattgtctcatatctttgtgtagcacagctgatttgaagttttcttttaagcacattcttaattatcttttcctttgatcttgaactgtttccctgggctaccagacagagagcctagagccctacctccgctttccccgaggtgcaaactgctccgtccttccacaggcaggcccctggctgaatgcacccttttctccatggttacccacccacctctctgttatttgttacttcccaagtgaatggcaggttaaaatgggaaaaggtcaggttatctgaatgtggttagagtgaaatgaatttcctcattgcacccaagaactgtcctttgacaggtctccttccccaaatcgggtcattttgtacgtaggctcactgggagtaattctaagacaactaaataagtaaaatcacattttggtgccattttccaatgtattcttcttcttgggggttctcctttaaaatggtactggaaggatacgttgtcttcattaatccattgtatgtcccgggggtggaggtggaggtggcagtagcagaagcccgtgaagtaataggtcgtattttgtgtttataaatatttctgcaggtttttgaggagaagatccatcattcttataaaggcattcatgacctccagaagattaagggctgttatgctagaacagtgtttcattcttaaaatggggtctctggactagcagtatcggcatcacttgggaacttctaagaaatgcaaattcttgagttctaccccagacatacagaatcatgatctctcagagtggagcccagcagcctgtgttttaatgagccctctgggtgattctcaagcccactcaagtttgagaaccactgtactaagggaactactgatgcatgatgcaagttcacgctcacaggcacgtgtgaatgacacaaagaacacagacgcctgagagagcaagaaagacaacatagactgtctgactccctgctgggcccttctttaccgcccctatttcaggctaccatgcccatgagtggatgacacgtaccccccgacaaaggtcaacaccactctcccttccacaccctatcactaagtgacaggctaagcctatgttaaactgctcacatctccttggaaattcaacactttaataataggtagcattatcacccccatcttcttctctaagccagaaacccaacttgcctccctatatgttatccttgcattcagtcagtctctaagttgtattcatgatctctcaaaaatatctccctttttctcatcctgtgtctattacctcagtttagatctccatattctcttgcctctaatgttcttgcctctaatgtaccttttcactgccaccaagatgatgttaccaaaaaatcttaaacagattagacatcttcacaggataaagtccaaacccttagcttgatacacaagccccttcacaatccaggccctccttcctgtgcagctatatatatatatatatatatatagagagagagagagagagagagagagagagagagagagaaattttgatcttaccactctgtctctcttcccgccatgggtcttcccctcttccctccggagttacttagctctgatgtgtattcttatctcgtcttatcttcaacttcattcatgtttttcccactgcttcaaatttcactctcccacttctcccctggccagctgctactcatccctcaagaccctgatcaaatatcatcacttgtatgatggcatctgcaaatcttggggggcaaggctaattgttctttgttcccacagggctgtgttccagtttaacatgatcacatgttattttggttcatttatttgcttaagactttttcagaaggctatgggctctttaaaatagagaacttacatcttgtagttttaagagtatttttagtaaaagtttagagtgacccccatctttctgccagcccacaaaaggaaaacatcaaaaagtgaatgtgtaaaaggaagagaactctgacaaaaccaggcagaaaggtttttcagcaagtctttttattttctgttcaggataacattaataattatccacgttggtttctcattctcctgttggtgaatatttttctgctaaatttaaaaccgtatcacaaactcaagcagagatttacaacatttcaacagcttttctacccctgccttagaagggtggatcaaaaacatttgtccatggtaaagcactatggacatgacttagttaacaattctctgtttgggtcaccatgaggcttcttcgtttatactcagggtcagcgacaatgctgatatgcagctacaatttctcatttcttactcagggtgttatgaagcagatttccactgttctttaatcgttattaaaatgtagtccaggtgcagtggctcacgcctataatcccagcactttgggaagctgaggcaggtgggtcacataaggttaggagttcgacaccagcctggccaacatggtgaaaccctgtctctactaaaaataaaaaaactggccgggcatggtggcaggtgcctgtaatcccagctactcaggaggctgaggcaggagaatcgcttgaacccaggagggggacagaggttgcagtgagccgagatcacaccattgcactccagcctgggcgacaagagcaaaactctgtctcaaaaaaaaaaaaaagtcattctcatgtaaaaattcttgtaaaataatctgtaaagtcatcctcttatctgttctagttcttcataagacttatataacatgtcatatgggcatggaaaggcctaagccttcccaaaccttgctcttttggggatgattttccaaatgtacttgttctcagttgaaaagagcattgcggccgggcgcggtggctcaacgcctgtaatcccagcactttgggaggctgaggtgggcagatcacgaggtcaggagatcgagaccatcctggctaacatggtgacaccccgtatctacttaaaatacaaaaaattagccgggcgtggtggcgggcgcctgtagtcccagctacttgggaggctgaggcaggagaatggcgtgaacccgggaggtggagcttgcagtgagccgagatcgcgccactgcactccagcctgggcaacagagcaagactccgtctcaaaaaaaaagaagaagaaaagaacattgcatcatggcacaaggacacaaaaaataccctggacctgcttcagtgagatggtctaagggtctctagcatcttctgaactgaactgaatgctttgggaagaattaatagatacacgatgtatattagttcgtttcacactgctataaagaacttccctgagactggggtaatttatttaaagaaaaagaggtttagttgactcacagttctgtgtggctggggaggcctcaggaaacttataatcatggtggaaagcaaaggggaaggaagcaccttcacaaggcagcaggagagagagagaaagagtgaatgggaagagccccttataaaaccatcaaatctcatgagaactcactcactatcacatgggaaaacagcatgggggaagccacccccatgatccaatcacctcccaccaggttcccccggattacagttctagatgagatttgggtgaggacacaaagccaaaccatatcacaatggaaagctcatgaatgggttctaagaatgaggaaatgtaccttagcattttgcctacttttcctttatgacatttttttcccggcaaatatgccaaatattacctacctttacatcagtgtccacatgcatatcccctgtcttcctccttttcctcatacattaacaaaagagtaactttgttttctccccatcactgttcaccctattgtataagagaagaaaagcaaaataggatgaaagaactatctaggcacacacacaaaagtcacactctccagaagaaagaatttgctctacttggtagtagacagaaattaactcactgaagatcaccagagaatcagatccaattatatcagcaggactttagtttacatcatggtactagaaccttctttaacattcaaaacttatgaatacctagaaatagttttaaggttaatatctctatgctgtgggctaaagagtacccacaaatgaatacagttgtgtctgatgagtgtctgtgattattttggaaattgtcctgctatttaaaatgaaaaaaatagaaatgtcttagattttcctatcattaacctattgtaaacaattacatcagtgtagggttgttttgtggttgcgtgggagtattttgaggtttttagggggtaaagtgggggatagaatgaagttgttgtttgcatttacaaccctaataattaaaacaagccagagggaattacctacatggctgttgtgatttctagtgtatgatcaaaaataattatggcactttgccatatgttcttgctttcttcttagatatgtgttattgggaaaagatgagacttgacatcaactaattgcttttttctaatatacaaccttgaaccacagtgattctctggaggacaaaaaatagcttagtgacaaagagattccagaaataagagcttttcgagcttttaactctctatgtaatatagacaaattgcacagattaatataaccaaatatgtattggtccatgggaagagagttacctatttgaagaataggagtgtattgtgttcatttagaaccattcagaaacatcaatgatattagttctgagttgactaaggataaatttttaaaagcaatacctaattggaaaattattcagttgttgaccattcctatcagtgctctgaaactaaatatctcacagatgccttaatgagttattataattatgttgctgtgatacatgtagcccaagtcagaagtcacttgctttgtatttaatggatggggaagacactggagcttggagggaagagaataaaaataacctagtttcaggaagatctatgctctaaccctgcttctgccacataacaacaactctatgatttgtataagttactttacctctcaaactcgtggtttcctcgataggggataaagaaggcctatttcatagagttggtgtaaaggatttataagggctgtaagtattagttcctgccctgtttcatccccctaccctacccccacccctcatcatggctctgcaaaaacaaatatgtctcagagttggaaagacccatctggtctttctcagataagggtagttttcttcaaacagactgattcctgcacataaaatataatataaaaaaccaaaagtaccttcaacattgtagacttttcatatgtggttgtctctgtgacttaaatgtacaatctagggtttgcatgttaaggtctttcaagattactgttggcactgatctgaaagatgtctcatgcaggaaatgctcacccaattatgagcactgaggctgtatagcaatatcagaaataatattgcagcacagtattttctatggattttagatgcagtattaaaaaaagaaaactcagcctgtctttaagactcgttttctctttcaacaccagaattaaaaggcatgccattcttttttaaagtttatgtgcagagccaaatgaatatcaacattagttctccactgggtccacggcttctttttaaaaatatctgaagcagtgttactctacccactttttctcaggaaattgtgtcctttagaactggcacccatatagtttaggaatgcttgatagggtatattttaggtgggagtcacctgtgcctatatggagctttgatgtcaatgcccttgtcatttggtgtcaatggttttgtcattctaatttatttggccccaaggtgtgtgtgtgtgtgtgtgtgtgtgtgtgtgtgtgtgtgtgtgtgtttgaaacacagcatatgtatttttttcttactccttgagaaatagaactttaaataacatttctatctttaaaatgtacttgtgaatagttatcactttcctgaattctaccttccaaaggtaggacaagagaaggatggaattaaatcacacatgcagctatttttataacttatgagcactcaatgatggtagcatccctcttctttaccttctctctgattctgaagccactgctgttttggttcctgtatggctgggactgcctgtccactagacttcctgccttcactctgaccctgctacatttaccctgaacaccatcctcccaataatcattaccagatgctattttcacaatgttacacctttacacaagaagctacagtggaatattatccttacagaatcagataaaaatctccaggcggcattctaagctctcattggctacactgtaccctttgaacctgaacttcctgagaactacctcttagctcctgcctgtagctctggctcccatcttcatgcagtaggtattcgttttcttttgaacggcctcatatcttctctgctagcaggattggagtcatggcagaaagtgagagggggactagaaggatgcaacattaatgaaacctcacaataggttaggcattgggttaggtacttggttgatctactcacatcatctcatctaatctttgccaaaaccttaaaaggtaggtattatcggccctacttatagacatacaataggtacttaatgcacatttttgtgatgaataaatattcgggaatttttgcattgtgactggatgagaagaaactaggaaaaacaagacgtagatgagaaagatacctctcatcttacttccaacctaggagatcttaaatgaactcatcagttttaaaaggtaatcttaagaatggagtcagagggtcacacaaggagagaaagcatcacgtattaccagagttcgggattgcttaaggcggtttgacagtttcctccgggggtaatccaccctaggccaggcatttttaaagattagattttgaaatgaagctttgcacttgggaatatactgaggcaagaaagcatatcccttctccctgctgagagagcatatcccttctctctgctgttgcagtgcttaagtgtgagaattttcgaatgagatatgaaagcaaagacaacaaaccctgcaggataatagtctctgaggactttaataacagccgtttttaaagcaaagcctgtggactcctaaatccatagctgctcgtttaagatgcaacgcaatgcagtggacctgaaaacatactccttatctacctagagcaaccaggctccaagccaaacagcagtcctcaaattaactcttgtttctcttgggacgacaactctgctgcttttaaaggtgttgcgtggccacatatagaataagaagggaaaaaacagtcacaccctcttgtgagtctgtatccaactgcattttctgatctggttaggaacctccggtggttagattagaatcctgataaggccaagactgtgggtccaatttcttcctatggattcttctcgaaaaacttgttaggaaagatccacttcgggtttttttttttttttttttgcgcttgttttaattcccaatccataatagactgatacttttgtaacatgcaataaaaatgaattattttaaaaattacaaataccagacatacaaaatttaagccgatgctttttatttttagattgctgtacacgtttctaaagatttgctttcaatttctgttcttatgtcttcataatagaatatctgtttctgtgtgtgtatacgtatgagtgtatgcaagtgtgctccaaaagctctactatttagagctcatgtttaatgagtcatgttggataaccagtctaagggagttctactttcatataattgtttttgttttatttttatttaaatcattaacaccttttcaaaacaactgtatcaaataacagtcatttggtcatttgaagcatttacatacactgctttcttcttaaacagattttactgaatgtaaatctgctttccctggctaattcagcatcatcatcctgagcattaactattttgcttcgctataaaacgaggtgatgccttcaagggctactgatgcatggagagctgttagtttccacactgtgtgaccctggtcaattatgcatgcccatggctccttttacacctttctgattctctgtaaggtgtcacttcttcctactctcaatttagccacttaggataatttctttactattttgaattgtatgttcctgaccttctaagttcttagaaatcagaccactttttttcccatcaagctaatttaaattagataaaaattatcagtaaggaggaactaatggccttataattattcatatactaactgctttcagaaaagcttagagataatctgtctataataaaattcttaaggagatttggtcacttattgttattctttctacaccattgtgtttgtttccttacttctcagctatattaaaatggggaagttttcatttgctgagtcctattttagagaccaataattccatttacataggaaaggaaatatgtggatacgattattcatgatgttctagaatagtatcacaaccatctgcttaatggttaataaaatggttaataataaaaagaagggtacagcactaattcttgacatctcccttctttatttttcttctagtaaaacatccataacttttcctattcttccccagttgtattattacttatgaacaccatggatcattctactttttgaatgaaatagtacaaatttaatattcgataatcttgtctttgtacttttctttctaaacttttattctcggtggcttcctaaaggaagactttattctacttggtttaagcagttggtctgcattctacctatttctctcaactctcattgtccattccaatcaggttgtgcaattcattgtccctgctcataaaccaaattcatttcacctttactccattcccatgctattctttttacctggaatattttcttttgttccaatttcccaatcgtatacatccctcaaggctcaagccaagtcctgtaacttcatgaaatctatttctaacatctgatttccacatggattatcttgtaatagtaagccctgcatttgctattatttattaaagatctcttgtgttctagacgctattcaaagtattttacaaaaattccatgtaatattcaaaaaattcagcaggtatgtattattatttcatgtttagtgaaaccaaagtaatgaaagagttttcatcattatgtggctaataagggaaagagaagagaagggtcaaacctatgtctatttaactgcactttgccatgagttttctctggaagctgagaaaggagattcacaacaagagtagatgagactcagataagaaggaagtgtggaatttgaaaaagcccttcagaaaacaggatctcccctactcctaaaactgctatactgtgaacatattgcttgtctcataactgaacttttttggtactctcagctgaaatttgctctataattgtacagaactttaggccaaatgtttcttttatggggacacacattatttgtttcgtttgcacccattttctcaattactttgtgttttctcttgttgtattggatgcatctctatccactgctacaaatctgtttaatagtctttatattaataagaccatgaaattgctctttgtgtgctgacatagttatcctttattttctaatggcagtgctagatttgctaaaatttaggtagtagcattattaataggaaaaactaccaccaacaactaaacttgaaaggtaatatagcctagtggctaagagcacaatccctgaagtctgactgacgaggttctaaatcttgctgcatttattagctgtgtgaacctgggcatttttagttaaccttacagtagtttcattatcttatatggaaaatgaagataatagtagcccctaccctagagggttgttgagaggagaaaatgagctcatgtatatacagtgctttggacagcacctgatgtacagtaaggttcatgtatgttgttgttcttgctgctgctgctgctgctatggtttttgttatgtaacaactaccttttcccctttgttcattcgttattgcttttcctaaagactacaatcacaaaaaagaagaaaaaaattagagagcatacagtgaatgcagtaatgaaggcttgaatgatcttttctagttaagtcagaagtgaaataaaactatccaaaaatttctatgaaaattatcctttgtccagattggctacccactgagaactccacttgattctccatatcaatcttttgctcttttgtgctacctgagtctgaggtgtagtctttaaatgatgagtttattggcacaagacagggatgccctctctcaccactcctattcaacatagtgttggaagttctggccagggcaatcaggcaggagaaggaaataaagggtattcaattaggaaaagaggaagtcaaattgtccctgtttgcagacgacatgattgtatatctagaaaaccccatcgtctcagcccaaaatctccttaagctgataagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatgcaacttacaagggatgtgaaggacctcttcaaggagaactacaaaccactgctcaaggaaataaaagaggacacaaacaaatggaagaacattccatgctcatgggtaggaagaatcaatattgtgaaaatggccatactgcccaaggtgatttacagattcaatgccatccccatcaagctaccaatgcctttcttcacagaattggaaaaaactactttaaagttcatatggaaccaaaaaagagcccacatcgccaagtcaatcctgagccaaaagaacaaagctggaggcatcacactagctgacttcaaactatactacaaggctacagtaaccaaaacaacatggtactggtaccaaaacagagatatagatcagtggaacagaacagagccctcagaaataatgccgcatatctacaactatctgatctttaacaaacctgagaaaaacaagcaatggggaaaggattccctatttaataaatggtgctgggaaaactggctagccatatgtagaaagctgaaactggatcccttccttacaccttatacaaaaatcaattcaagatggattaaagacttaaacgttagacctaaaaccataaaaaccctagaagaaaacctaggcattaccattcaggacataggcatgggcaaggacttcatgtctaaaacaccaaaagcaatggcaacaaaagccagaattgacaaatgggatctaattaaactaaagagcttctgcacagcaaaagaaactaccatcagagtgaacaggcaacctacaacatgggagaaaattttcgcaacctactcatctgacaaagggctaatatccagaatctacaatgaactcaaacaaatgtacaagaaaaaaacaaacaaccccatcaaaaagtgggtgaaggacatgaacagacacttctcaaaagaagacatttatgcagccaaaagacacatgaaaaaatgctcaccatcactggccatcagagaaatgcaaatcaaaaccacaatgagataccatctcacaccagttagaatggcaatcatttaaaagtcaggaaacaacaggtgctggagaggatgtggagaaataggaacacttctacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcactattcacaatagcaaagacttggaaccaacccaaatgtccaacagtgatagactggattaagaaaatgtggcacatatacaccatggaatactatgcagccataaaaaaaggatgagttcacatcctttgtagggacatggatgaaattggaaatcattattctcagtaaactatcacaagaacagaacaccaaacaccgcatattctcactcataggtgggaattgaacaatgagaacacatggacacaggaaggggaacatcacactctggggactgttgtggggtggggggaggggggagggatagcattgggagatatacctaatgctagatgatgagttagtgggtgcagcgcaccagcatggcacatgtatacatatgtaactaacctgcacgttgtgcacatgtaccctaaaatttaaagtataataataataataaataaataaataaataaataaaaaatgatgagtttagacaaatatcattatggtagtattatattatgttatgttatattatattatattatattatgtataatgtatattccttgcagcctgccctgcattcccaatctatgactcatgctgccttattgatactgaaaaatctccactacagcatgccagcttttgaaagagagccttgggttctttcccaatacttaccttccttttagggcaacctatctgagtcctgtagcttgaaagatttcctaccagcctgccatcccaaaggaacatggatgaactatgtttatgctgatgtgtcaagtcatttcttggtatggttcatagtagtccacatggctcttgtagacaaagagatgaattactgatggcagaatttctgttctggcaacagggaaatttgcagaaaggagaccttttcagtgtgaacattttttgctcacaggtggtccaggatgcccaatgctaaatgagaagtgaaaagagcaatcagggccaggtgtggtggctcacgcctgtaatccaagcactttgggaggccaaggtgggcggatcacgaggtcaggagatcgagaccatcctggctaacatggtgaaaccctgtttctactaaaaatacaaaaaaaattagccaggcgtggtggcgggcgcctatagtcccagctacttgggaggctgaggcaggagaatggcgtgaacctgggaggcggagcttgcagtgagccaagatcgcgccactgtgctccagcctgggtgacagagcgagactctgtctcaaaaaaaaaaaaaaaaaaagagcagtcagaattcaatttttcattcagaacaaatcaatccacgtgggtaaacattttatcaaactcaagaatgctgtctttcagggtgcttttccctcaacagtcacttatttcctcttgcaagtagtatcttcgttcaggttcagtgactactgtgtattatatccaatgcttctggcaagtgggttggtggaggcagcccaagatcttctagaatcaagagaattggatccatttcccagttctaacacttatcagctatatggcttttaggcaagtcagttaaacatccgagtctcagtgctctcatctgcaaaacagaaaatgtgatgtacttcacagagccagggggaggaataactaaggtggtacatttgtacgtgctttgtaacctgtaaagccctttactgtacacgtgtcatttacagctctgtatcaccatcatgacctagaaaagcagtactgacagaagacttatcttcttgccaatgctaagataactttagccatttctgcatttctaaaggaaggagtctttatcccagtatctatgaagacttggcaggaattgccgtcaatatttagttggtaatataaacgaattaaacaaaaatgcacactaggttttaggaaaattaaagacagaactatcatttgtactcctcttacatttcccaaagtgctaaaactagacaataaatcagtcctcaataaatgcttgtttatcaattttatattcatttatttgttgataatacaacaaagatgtttatatgcagtataatatatatggcaaagatgaaaagtagcaaattcatgaatcaacatcctatttatgcttgagaagacaaagaaagtgttggtgacttcatggtatacataaccttaaggagctcgtgattgagcctgggtctctgctatcaatgtaggatataaatttcaaatgtactatcctttatatgtatgttaatgtagtaaacatagaaaactgatgctactagtgagaatacttttacttgaacaactaaaagtttgtctttaatcccctaagtgcatacacaaaaggaaagtactgtacaaatcaagtacaacagaagaagtaaagtaaaagacaagtgaaggaattatctggaacttagatctggttggctttttctcctgaagtacttagataaattaactcacttttctcttttgctgaagaagtgcaaattaggcaggcatgttattccacgtaggcaaaaggaaaaaagaaagaaaaacataaaatggctatatatttgaccaaacttcgttctgcaagaatcccaatactaaccttctaccatataaactactttcaaaatcaggctatatccttccagtacaaacctggtttgtactactcagagatactactcagaaatactttcagtatttcccttctttcaacttctgatgtgattctatccatattcccctgcctgtctcccagtcaaagagaatgggacacaactctctttagagtccatcagtgatgctttagctgccaaaaatagtgacaatagacattcattgtctgtctaccttacttgttcaacattcagaattctgcatcttaagaggctgtggctgaaaacttgagccagttcttcagaatttctaacatgttatttctgccactttttctcccttactttagcagagtaatttaattcaatttgagagagagagagaaaaaaaaaacttttctagttacacagatcaatccaattgtttggagcttcagaatgaatttttaaacttgttgaacagaagcatacaaatctctaagagcaagtcagataatatacaaagcctccattcattgtgtaggcagaaaggaatgctggtacccggcagctctctgaggaatgttcccttggctttgactattctgctgggaacaaggaaggaaacacatatataaaatgaatttataatgtctctggcttgtaatggcagaatgataagaaaagttggctgtttaatataaactgtcagttgcatattccaggcctcctctctttgaggttcctcccacatccacacgcctggctactgtttagtgcggagtacaaagtggccgtttattattattgactggtgaggcctgtgctccaaaattcattctgtcaacagaatgtaagcaaagttggcattttaaagcagggctctttcagtttctgggttttctcaggattgctatgcaacaggatcagtgctgtagtgcccggttcaagctgaaaatgttacacaggaagacataccatgtaaaggtcagattcttctactataataattttcttgatctgtgtgtatacaagtgaagttgaatgcataacctcttatcataactcttaccaaggtcctatgtactttccacctgtcaagcctaaaaatgtgtattaaatgggaaatcaaaactaataaatgtatgatgctgtactatatgtatgatgctataataccaaggtgaacttaatttgtgttgtcaagaagattttctctcccatgacagactcccaggaatgtgctggtgctgtgggccaagtgcaatcttgtttattagtctctccacgcttttatggtcagagttaactctacagattactacgtaaatagaaaatatgacttgatccatatagtaatgaaattattggcactggggtacactttatcatagaattttattgcctatcacttccataaaataatacattttgtccatagactagaagatataacttgtgaactttataaagttataaatacattactttccaactcataatggcaaggaataaatctattacaactaataagatgcccattttaaatctacataataacaggagaaggcaatacgccaagaaaagggatttgagatgtatcttcttgttagtttagcctgattgaaatgtcttttgaactaataattatttatattttgcaattctccaaattcacattcatcgcttgtttcttttgtttggtaattctgcacatattcttcttcctgctgtcctgtaggacctccaaggtgaaattgaagctcacacagatgtttatcacaacctggatgaaaacagccaaaaaatcctgagatccctggaaggttccgatgatgcagtcctgttacaaagacgtttggataacatgaacttcaagtggagtgaacttcggaaaaagtctctcaacattaggtaggaaaagatgtggagcaaaaaggccacaaatgaattaaaatggccaaattttcctcattgtcttagcacaagtaactggtatctcacatgtctacgtaaatcatccaatttcagaatgattcactgtattttgaataaatgaatcatttatttgcttggtatggagatgatacttgaggattcagattagattaaagtggtaatgttttataaacataggagacatgcatattaagacatcagagtgaatttaaatgaggagtgcagctattctagtttcataaatttctctcttggcatatcacagggttatacaaaaagtgataaaaaattaacggatatgtattatggaattatttttggcattagtctaaatgcataccagaggacagtctttaaaaccctttataacacattacaattatataatataaaacctgtaacacattataattaacagtttagaggagatagctcctacagttaaagagagactatagcaacttcctgtcttttgcttcctctcagattttgttaaaacacatcctctgtaaactaagcttttagttgtagtatactcacatactttatattttgcccccttctatgtgccagctttctttggagaagttagttaatggatgcatcatagcatctttgtaaaaagggcagagggaagttcttgttataccagttttgcaatagttccgtggaggaacaaaaggatagagatagtaagtaaaacgcccattgtaacttaaatgatctagcaagggcggggaatgaaagccaggcttcctgctttctaagcagttgcctttcttaattcatttctctttattaaaaatattttgtgctttcttctgtgtctagagaaaaagtgataatgaagggaggtagaagatgaccaaatggacttaataatagttatgggagtatacactaaatgacgggagtagttactacctctaggtagaaagattacagaagggagattttttttcttctttatagttcttctaacttgtccaaaattttaacatatatacttctataaggaggaaaatctgcatttttagtaattcagaagcactattgtaaatgtctgcatcaagtatgaaataatgatagcaactaatatttacatgatgtacctacataccacgcaatgccataagcactttccattcattgaccggtttaatgctctcagcaaccctaagaggtagattttattattgaattctttttacatttgaagaaagtgaggcacagagaggctaaataatttccttagggtcacttagcaagtggaagatacaagatgaaaacagggagtctgggtgggccaggcgtagtggctcacgcctgtaatcccagcactttgggaggccgaggcaggtggatcacgaggtcaagagatcgagaccatcctggccaacatggtgaaatcccgtctctaccaaaaatacaaaaattagctgggcatggtggcacgcgcctgtagtcccagctactcaggaggctgaggcaggagaatcgcttgaacccgggaggtggaggttgcagtgagccgagatcgcaccacttcactccagcctaggggacagagtgagactctgtctcaaaagaaaaaagaaaaaagtaaaagaaaaagaaatcagggagtctgacttcagagtctgaacttttaaccaccatatgataccgtagcatataaagaaagaaggaaacttctacaaagaaatgcatactaattgaaaggatgaaatagagagtagattttttctaggagtagaaaaggatttgtttttatgagaagtagattgctaggagtagaacaggtttatttttatgtataaggttttgttttgttttgtttttcacaagtttgcaccctggcttcccagacattgttccttatctccctattttgtatatgaattttgtgtcaacttggtggtggtacactgggagcaacaatggcaatagcattttcaaagatagggaggctctattagctttctacagcttaaactcttaagagaggtcagtatgtgtgatgacgtaggccactttgataaccttcgtcattaaaaaagaatgaaaatgtgagatggaaaaaatattggcaggtcaagttaagttattcttttctgcacaaaagaaaaagaaagatgctataattgttccgagtatcacttagtgccttttctctgcctcatgtgaacttgataaaataaaaggagaattgaaagtggcaaatagcatgtcagccaaaatatggactcttcattctcagcagtttcccatgtcagctaccgcagtttgattcttgctgtcattaatcaggtagaaaacagttagcttatctaaggtgctgccaattctagaatttaaatattcagatcaatggttttggcttttatataggcctatgtaataatacaggatatgttataagcactcataaaaagcaaagaagtaattctccacatcaaagcaatttagcttatttcctgacacttgattgaaattagggtattgatcaatctacagcaaatggcagggttcaattgagagaagtacagtataggcagtaattagggatgattatgaaatagaatagaataacactggaagagttagatatagaaccattagtggcactgataaacctgcattatgaatcttgtcacttcttccatgggggttattttaaaatgaaaagttgccacaattaaaaaatagtttcaatgatatactggaaaaataggcctgtgtttgcccaagttataacatattataaaaaattacagttggcccattgtttggtgagcgattctgaaactgctcttatatttcaaaaaaataaaaccattaatgtgtccatttttaaagaaacaaaattgaatttaaatccaaatgatttcgaagtttccctttgtattccattggctcataagagatatccttgtgcttccaaatacaagtccatattgtatcgttttccttccatttatttttcttctgccatacatcttttctcttcctgtgattaagattcttatttaagtcatcatgttatgccatattgatacatttgcaagaatactctaccttggacgctgtttatatcatattactcttttgttcaaagcttcaatcttgtaggtctccatatctccctcattcatttatttgttcattcaacaaatatttaatgaatgcctactatgtactaggcactcttctgggcacggaggatgcaaccatgaataaaacataccaaaaaaaatcactgctctaatgaagttatatttaatcattagaatctagtagaaccttctctctctgccaactgtgcctaataagtccttgctaactccttcccttctcttttctttttctgcctccagttcctttctcaccaagcatcattctgttactccccaacatagattctctgagccaagagaatcaataaattctattttctaaccccattcctactctccaacaatttcctcactctcccatatgagtatgtacccttgctggttctcacacttgcaacattctctttcctcttattctccaaattttgattcatattccataacaaatcttttcttttctggctgtttcctcactaggtcttcccaatactattctaatttacacttgataacatgtttcttcaagtgttcaagagttgctttatagggctatgcttactgcctccagctaacttatatgaatacaaaaatttcaaactcgaaatatgtgagtatggtagagtagaaagacatgggccagcagctgggcaacccagtttcccttctgttctattctgtcactaactgtcttagcatataatcttgatcaagtcacttaactgcttcagacttcaattttctccttcactgaaatgaagagtttgaccagaaatatggacagtctcttccagttctcttgcaatcgtacaattttattcttttagttctgcaatcacactttatgaacctggaaaattgtttaatttttctaccttggttttcttaattaaaatagaactgattgatttaaaaggcattatataaagtaattaagatgtctttgagagaaaagaaatttaattgaaattgtataatcctatctcataatttaattcaagaaaagtatatgctatcattccacatgcattattacatcacatgttggccaagaggtataaggaagaaaagtaagtagtcagtgataatttaagttccatcaaacaaaacgaaaacattaactgctttaagtgggagaaaaagagaaaattatttacttaaatgtacacacacatgcatacacacacagttactgatgacgttatccaatattaagatggtaattagtcaaagaaagtgtttttcattctaaaattccatatccacaatccttgcatttttaattttagaatattaataacttgagaagtggtcaagtcaattgttttacataagaaatatatatgaagatttcaatttagtctactactagattatttttccagatcattgtatatactattaactatgaaaatcacataatatgttatcaacataatttcagcagaatttacattatgtgagatttttatatttggcagaaaaatttgtaaatgttatataaaatgttcacatttatacaattgtgaacattaagaggcaaggacactgacattatatagtctgtagaagccataaatctattggggagtgcttgctattagaggttagaatagttagtgtctttgtataatggagaacaaaagaagggcaaaaagaggtggggtctacctttgagagaaaactgcaacttggacattgaatatctctgaccttctttctctctcttttagaatgttaattatgtttggatgttggagttcaagacctgtctagaaaaaaaaaatgttgacttctctttgggattctctctatttaaagagatagctcccattttaattctgtggttctttaattttttttgtttctgaagtacaaattcaaattattcatctgttgatgacaccctggagatttttctcagtgttctcttgtagtagtttcatggtttgaggtcttacatttaagtctttaatctactttgatttgatttttgtatatggtgagagataggggtctagattcattctgcatatggatatccagtttttccgcaccatttgttgaagagactgtcttttccccactgtatgttcttggcacctttgtcaaaaatgagttaactgtaggtgtgtggattcgtttttgggttctctagtcttttccatgggtctttgtgtctgtttttatggcagtattgtggttctttattatttctgcattcctcccttttctttctgcatgtttaagtgctattttattacatgagggtactaaagatttatagggatatatcattagttttataaaggaagtcaaagtgaaaaatgaattcaatataacacatttcactttaagaatgcatgcctttcagagtaaagttttattaaggatttcaaactaggcattaaccaaatcacagttgaaatatctgtgtctagagaaataacaatcactttatcagcccctataattcttagtgtcctgacactgaggagttccttaaagaccaagcaatatactccagcacatctaaaggctctgcgttttacctaaaccttacaaattgtggaaattatcagctttttagagattagcacttgccttgttaaacggtagtaacccctaagctcttgtcttcactaataaagattaatagacatagatagaagctaagcatgcccctttgaaccacctcttttattttccgttgagtgggtaggagtaagcagaatatatttgacaattagcaatgttaaaagacaaactttagacaaattccgttttgcagagtttatttgagcaaaaaacaattcatgaatcagacagtactcagaattagaagttcagaaagctccacccagcaaggtgggcaggcagtatttatagatagaaaaaggaagtgacatacagaaacagcttgactggttacagcttagaatttgccttacttgggcatagtgtaaataggcatttgccttatatggacatgagctgatcagtttacagcctgtgattagctgaaacttgactgctgggattggctgaggctcagctatttgttacaagaatgtactcttaagttgcatattgcttacatgccaagctgggttgcagtttgctatgtacagagtcagctttaggcccaatttaatttaatttaacagcaacaagcctttttgttcagagatcaaaaacatttggttaaaaccactaaggtttaaggattttctcatctaacaaaggtttgtaatttctatttcccatatctaaataggacagctcaagttatgtttttcagcagctgttttatacctttgcaatcttgatttctacatatgcaaaacaagaaggttgaactataatctctcaggttccttccaaccccaacagcctatgtatgatataaccagaaaaaaaagtcattacaaatacaaagaaacattttcaggaggagatattccacatgcaaacataggttaatcatttcaaaatatctggtatatacactcatgaaaataaaaatagggcaactgcttccgataaatgtattagaaatgtgacttgaaaacatttcacgggcttaacatggtcaaagaaaatgttttgagctcacaatgttccttacatttagatcttcaaaatcaagtcactgacaaatgccacctttgccctgtggagaccaagaagtaatgtttggggcatatcagaaatgctttaataaatgctttatcaaagaatggttctggagcttacctgtggaattgtgaaggttcttgttgaaagcagagattgttgatagaattatagaaagtctggaggtggcacctagcaatctcaattttaaacaagctactcaaatgtttcttatacacactatagtttgagacccagagctttaggttgaatacatttgtatatgctgttttaattcattctctggctgcctttcacctcttcagttcttactcagtgttctctgtcctttgtaagtttttcgcttcagtttttgtcctcctatcacatttttcctttcactcttgagctttaggagaggaaaaaaatgaagcaatttgatatgtagttaggatgatcaaacattctgaaattttatctaactccacagcttagaaaaaaattaaaggaagtccccttacccagatatgtgagagcttttcgtcttttgaggttccaggtccgtcttctgctgctgtattagctctcttgactgtcctctgtccctggcttctaacaacttccctatttcatgctattaagtttctcttagatcctttagaactgaattcccggctgggtgtggtagcttacgcctctactcccaacactttgggaggctgaggcaggtggatcacctgaggtcaagagttcaagaccagcctggccagcatggcgaaaccccatctctactaaaaataccaaaaattagctgggtgtggtggtgggcgcctgtaatcccagccacttgggaggctgatgcaggagaattgcttgaacccgggaggtggaggtgcagtgagccaagatcgtgccattgcactccagcctgggtgatagatcaagactctgtctcaccaaaaaaaaaaaaaaaaaagaactgaattccctaggtctcagttattttgctctctcttaggggacctaaaggggttcattgacccactaataatgagtcagcaccatttaacctagaactggaattttagcacttccttacataaacaaagccgcagcttgaggtcttaacataggcagcctgcccttcactatatcctcctctagacctctctgccacaaggatattttgtttcctctaccaggcagacagaggccaaacattagtcatcgttatattctctcttcccttcctctctccctactccccaatgtatcctagagacttaggggcagtcaataaatatttatttaatcagtgtcttttctaccatttgctgcttttccatgtctgagccctacctctctccacctacttttcaatatgtcctgcttgacagcctcttttcactctcaaagggaccaagctgtgaattccagacaccccaaggaattcgtttaaccattacacattacatgctattaaacagctaaaatcttgcatggggaattgtcgcttaggcttatcatggaaaagtggtaactgaaaggatggtacagaaacataaaagaactgacctctaattgtatgcaatctgcatgcactattatattcaattcatgacatttatggtatttcacgattcagttcttgggaaataatacccttagagtctggaacaatttaatttatcttatttgatggaaatgccttcatttttcctggacatattgtttatactgcaattatagaaagaaaatcttgacaatttggaaaagtagaaagattaagaaataaatcacctgtaaatctacctctgagggataacctggttgtcattacaaaattttttcctagtcaagcatgtgcatacaaatacatacacatacacaaatgttttagaaaaattcaaaaaatgtatttgttttgtaacctgttttctcatttagtaactgggatgatgaccttttccatatccataaatatttggctatgtcatcatattgaaccttgcaaaggattttactgtatgaatgcaccattatatatgtaataattcccttttaaattaagagctatttaattaaattcatatataaatttcattaatttctaaatttaaagcatatacaagtttcattacatttgaaaacaatcagtaggttggggttttgcatttctcaagcaattccctcatattgaatatttaagttgtttctgttttgttttatcaatcataaatgatgctatatataacatttttccacctatatctttgtatctttttccaatttctttgttagtataatttccttgaatttaagcctgtgggtcattgtctttgcacattttaaagacttttatgtattgtcaaattatccttcagaaagtttggaacaatttaatttcagtagataagtattctttggtgattctgtttgactaaggccaaaaggagaattgtatttgtaatgtcaagctaagttaccaaatggctaagggaaatgttgctccacctggttgctttgctttacatttcaatctttgcagcgttaaagtctttattatatttatgttataggtagcgttattatgaattaattagtaattgctgataatagctgagtgattgagcataatttctaatttacctgaagataaagctttgctaacactgcgtttcctctttgttttctggatgatgatttattttattaatttagcttctcatcttcaagtgaaatgtggattttatagcacagatcattcatttgtgtattcttaaatggcttctaaggattaacgtgttctaaatacagttgacggtaaagcactcagtctcctgcctaaattattcatgttcgggggaagctttcagataaatgtctgattttactcttccatgtgagttgttgtcttagtactttttacacaaaggaaacaaagcagaaaatgttgaaacttggtgaagacaaatcccaggtgcacacaaataaagaagggtagggggaaaggagacgcatttgggaagaggagcagaaaggaacagacgccagatggaagaactcaatggaaaaggctgcctagggtgtagaaatggaaaagtcaaaatgtggggagagacctttccatttctcaaggcaaaaagaattccagtactagcatgagtcacatgaaaacgaagtgtttttcattagtcactgcatccaattttttctaccagaaatattaagaattgttgactacaacagtatggaaaagcaatagattccagtgtgtatttcatgccaaaagtctcagcattctgcatgtggaaataaacatatggctaaacactgccttttctcaaaattgccatcaaactatcctctgttttgtggctctcaaaagtaagtagccagatttttattcaagactgctttgtagttcacaataggtttattgtactttttcaatggaattgttagaatcatcaattacacttctagatattctgacatggtacgctgctgttctttttcaggtcccatttggaagccagttctgaccagtggaagcgtctgcacctttctctgcaggaacttctggtgtggctacagctgaaagatgatgaattaagccggcaggcacctattggaggcgactttccagcagttcagaagcagaacgatgtacatagggtaggacatttttaagcctcgtgccttgcacatgttaagcacatagtaatccagtgactattttaaaattaattttgtttgaaattaagttgaatagaaatcttttttactcttctcacccaagggtcaattataaataatctaagccattacactgtaaatgtcaaacacatttgtgttaataataccctttaagaaatcgtccatctcttttggctatataaaaaaaagcttttcatgatgaaaaatattgaacatatacaaaagtagacagaatgctataataaaactcgtactcatcaagacatcaacaattatcaaatcacgtcagatcttatttattctatagctcttcccagattgttttaaaacaaatatcaggcgtgtgttattttattgttaatatttcaaaaggttaaaagataggattcactcttttaaggtaatcaccttgctactataatgcttttgaaatatcaataatttcatcatatcaaatatccagtccatattcaaatttccatttttctcatacatattatgcattttttaaactttttctggttttggtttaaataaaaattgaaatcagacccacaccttactttggttagttggtctttttattactttttgtttggaagtaattacagattcacagtaagtttctaaaatagaatagtttccctgtatctttcaccctgtttcttttcatcattatatgtcatgcaactgtagtacaattcttattgtcatttcaacatgcaatcaatagaaaaaatgtacatttacagcacatctcaattcaggctcattacattccaagtactcagtagccagatgttgccagtagctaccgattgaacagtgcagttctatagtttgattgtatttgggtttggctttttttggcaagactgcttcacaggtgttcgtgtattcttccatcatcaggaggtggtatataatgccttgttttctctttttgtgtgatgtttaatagctgttcacgatcagtggctaggggttgcagtgtgataattgcctatctctaccattccttcttcatttattcactggggtaggtctatgaaaaaaatgttttgcacttgtctcctattttggtactcagtatacctttcataccgaacaagcaaaatacgtttcaattttaccaatttttataataacaacttgttcactagcatcctccaacgatgaccaattatttctttgtttgtttgttttatttttatttacatttctatcttctctactaagctctgagtgaaaaaggcagagattttgtcttgttcacctccaagaccctagagtctagtaaagtgtctggtgtagagtggatactgataagtgttttggaaatgagaataaaagatacaagaacagaaatgaatagcaaaccaaacaaattactaccaaataataaaaacttgataaaatggtaccacttttgtatgttgagcatgtaaaggaaagatctctgtggagatacagccaaaggtggcatcttgaggaaaggtcaagggtttatattattctggagaagaggatataggaaattataaaaagggaagagaacatgaaagaagacccagggatctttgcaaaaaaaaaaaaaaatgccagggaaactgccagtttctcctttagccatttgccttcatatatttctgaatattaaattagcttttgtggtagggtgaaatgtaatggtgctatgtgttttaaatgttctgactttgaataaacagccaaaacactctggtgtacatatagaaaagcactcattgagaaggatgggccttttttaaaaaatgcattatgcgatatagtgaaatgagacagaatttctacaaaagatgaattttatgctagttccagaaaccaaagaaaatgaatcactggacatgtgcactaggagtcaggagactgagattctagtcatatttcttcataagatggattctgattgctattttgttcttcaactgtaatatgaggaaattggtccaaataattgctgtggtttcttccagccagtattttgttataaatactgcttcactattcctggttattagttttggttgcttgttaagagtggtaaaatgtctgtacttaacgcagtccttactcaggaatctcatgacaaagaacatgacttggggagatggtgatgctagagttatgagtgatactcaccagaatgaagttaatccgtccccacttggttagtgtgcttgctcagatagctacctgttaacctttcgtgaatttcacaggacttccagcccattgattactctgtgttttatacattagttcctctgcccttccatatttacctccttccaaatacaacttagattcaatcatctaaattttaataacttgttttcaaaagtctgaaaccctttgcttctttatctttttgttgctgcaatctacaaaactccaaaactctagctaaatattccgagactctaactaaatattttctcataccagacaacaatgtagttgtctggtacagtaccttttccggatgaccagccttcagccttccactaccaagacatcactgggtcaatttttttttttttttttttttgagactgggtcttgctctgtcaccaggctggagttgcaatggcacaatcttggctcactgcaacctccgcctcctggttcaagcaattctcccgcctcagcctcccgagtagctgggactacaggcacgcgccaccatgcccacctaatgtttgtatttttagtagagacagggtttcaccgtgttggccagatggtctcgatctcttgacctcgtgatctgcctgtcttggcctcccaaagtgctgggattacaggcgtgagccaccgcacctggccaatttaccttcaaaattgtttttgactgtctactattgttatcatcataattatagaagaccatttctcctaacctttctgcatctactcttgccaccctacaatgcaatctctacatttcagtcagaataatctgtgtaaaaaacataaatccaattatatcagtccttatcttaacactatagtagtcttctcagtgctcttggaaaaagaccaaaatcctcaacaagggtgacaaggcactatctggcttgtctggcctcagcctcctctttcctagatgctcttcccttgctgtttggatgccagccatactgcctccatttactttttccaattctgcgtgtccctcttatgtggggctttaaatatgttggtcctctgtctcaaacccttttacctatacccacccactcataatatcctggttatcatctaataatcctttacatcttggctcggacattgtgcaaacttttccctgttgtctacatttgaccagatctttctttacacacttctaaaattgtctacttttctataacatagcgttgtttgtcatcacgtacatgtgttactatttgataaatatcgactactcttgctaaaccatgtccttcaagaagatttttgggagggggaaagctgtcatttttctactcagcacattccaaagtgcctagtatacagtagacactggttagataaaggaaggctattgagaccaagagcagggaaagaaagaatagagtggtattcccttcttatttacaggagttttctgtttatttctaattaagcatctttttgtaaagtgtgtagagctactttgatgcacaggtttttttttattattatactttacattctgggatacatgtgcagaaagtgcaggtttgttacataggtatacatgtgccatggtggtttgccacacccatcaacccgtcatctacattaggtatttctcctaatgctatccctcccctagccccccaccccctgacaggccccagtgtgtgatgttcccctccctgtgtccatatgttttcattgtttatctcccacttatgagtgagaccatgcagtgtttggttttcggttcctctgttagtttgctgagaatgatggtttccagcttcatccatgtccctgcaaaggacatgatctcatccttttttatggcttcacagtattccatggtgtacatgtgccacattttcttaatccagtatatcattgatgggcatttgggttggttccacgcctttgctattgtgaatggtgcttcaataaacatacgacatacagcttttacttgtagtttggcgcaatgctttttcaagcttctcttggtatctttaagaaaaattcttgacacaaaacactctccttcctcaaacaacatcatcgctcctgagtgctgatgagagaacagtttagtagcctgtttgactcaaagttttgtcacatgtatgtggtagccctttcatatatggactgtctagttagtgatgctcttgaagcctatgggcaaaagaacaatggaaaatccttgaaactggatctgcgtatcagatctcctgaactcagttagaaaaagagaaaaagaacagaatcagtacaaaattccatcaagatctaatagttgacagatcttatatttgtggacttttgttttactttgccatgtttccagaattgtacattgtattgctctttatgggtttcttgatttaattgttgtttgtatagaatccttggtatcaagatgggtcactgtaattgtaaacttattccgcaagtatttagagtgccacttttttaaaaagtcatctgcttactctctattctaaattattaatatcctttgctgatgctttttatggggatacaaatcccattaaaatgtcaatagttgaaactaaaatcaaatgttgttcattttcactttcattttctataaatcaggatgtttacaaaacaggtaatttgtgtttttctttgtataccatttcagattagtgataatattttgtagcaaaatattacatatcttgtactcttttcttgtagagaaaatatacagtcaatatcaattgctgtcatggagagatatatggttcttctgtaggtaaaattccaagatactccacagacatatttggggaccatagtctcactcctcaaagcaattttcacacccatgggagtagatctgtgctccccaaaccagctgggcagcataacaactgcaactgaatggctctcaagactaattaataaaataatgctccagatgcggtgaagtgttataaataattaaagctcaaatatgccttagcaaatataaactgaccaatttttatgtcttttgaatacattatcctggcttttacagttcctcattacttgcctcactagactgactcgttttcaattagtgggtgttattctggtccagatatattttaaaaactgacttcctttgttttacttgagcagtcactaaagtgatatttattacttgtctacttctgtgattaacctagagagagttttaaaggagcaaatcatagtggggaatttctaaggagaactgcaataaaacatcagcttattcaactcccttcctcctaccccaaatccaaatggagattagatcttgattgtaacaacagtgtaggtaatgactttttgtttgcctttttactaatgaaattgtttgtcactaggttttcatctttcaattaaaaaaatctctataatcccttccctagagatcattaaggataccttcaaagcttcccgagattttctggttaagatttagatggaagtaatcaatacatacattattaaaagagtggacagaaagccattattgcttggatgctgttgacaaatgaaaaggcttgaataaagtagtttacttgttcatttgtcaggtcatatattatgcatgttcgatttcttcagaagtcaccacaaagtgagagacaggctgagaaattcaataaaattatcctgaaatcatgttgtagattatacatttatttaggctcattctgttatcagtgctggcctgcttacgtgggatacattttagtatgtatgttagcttgacgagttttctgtgttttctttttacagaaagagaaaatatctttggatgtcatttgtgaatgttaagatttaagtcagctctgtgttaagaaaaatgcgttgttccctatcacctctgaaaaacaaccaaaagttgcgatagagtgattcattcttttttcttttctttttatttattttttctttaatttttttttgagatggagtctcgcctgcagcccaggctggagtgcagcggtgcgatctcggctcaccgcaagctccacctcctgggttcacgccattctccttctcctgcctcagctgggactacaggcacccaccaccacacctggctaatgttttgtatttttagtagagacggggtttcaccgtgttagccaggatggtctcgatctcctgacctcgtgatccacccgcctcagcctcccaaagtgctgggattacaggcgtgagccaccgcgcccggccagagtgattcattctaacattcaatgacctggcctcttagagtttctaaaccacttgactgttagttatatctactctaaggtgtctttttagccgcgttggaggaaatagacgtctttttgatctattcttcatcatttttgtataagtttgatatcctatgcagtcatatttagggatgctgaatagaaatgacttaaaaattatttttagaactgcatttctaggcatttgagtcttctgaaaactaagtctaagtcttctgaaaactagctttatcatcaaaactgaagaactgagtcatctaggaattgctgctttgctttaatgactgtaacaagatgagatgtgaataatttacaaactgacttctctaccagtcttctctctcactttgtcaaaatattttgatgtcctgacaaatactctttaaaacagtatctgcatagtgttttgccttgacaaagcacttttacacacattattcatttaattacaaatgatccccttgatttttttctgtgctcttccttttgtcccccaaaaacattattttaggaaaaattataccataactcagattcctagaatttattggttctttcaagaactttttttatgaagagcctactctatgttaagcatatgttagggaacaaaatgagtctctgcccctatggatgtttagattttagtgacagaaatacatagtaaacccataaattaatatatgaaattatgttgggtagtaagtgctatgaagagaaaataaacaaagcatgaatagagaaagattgaggagtactggcctatgtgaggaggttattttggggtaaagacttgtgtgaggccgggtgcagtggctcatgcctgtaatcccagcactttgggtggctgaaacaggcagatccctggacgtcaagagttcgaaaccagcctggccaacatagtgaaactacgtttctaccaaaaactagctgggcgtggtgacacgtgcctgtagtcccagctacccaggaggctgaggtaccagaatcgcttgaacttgggaggcggaggttgaagtgaaccaagattgtgccactgcactctagcctgggtggcagagtgagaccctgtctcaaaaaaacaaacaaacaaaacctgtgtgagtgagtaaaccatgcaaaaaccttgaatgaagaggattctaggcagaagaagcaccaaattcaaaagcccaatggtaagaacaggttttgagtgttgtagaaatagcaagatgagctgtgtatctcaagggaaataagatcagtagacagtgataggttctagaaagagggaaaggccagataatgaatggtcttgcaggccatagtttggaggtggattttattctgtgagtaaagagacatcactggaagtaaggaaacatcactggaaggctctcagcagggatgatgtgatctgatttatgtgtttagaagttgactcttgctgctatggagaattgactataaaaagagcgaaactgaagacacagaaaaggagggtggtggagtcatctcagaaggaaatgattacttggactagagtggaaatgataggtatggtgaataattatttgatcgaagatatatttggagggtagaattgatagaacttaagatagatagaatgtggagtttgagaggaagcaaagagtcaaggaaaattctgaggtcaatggcttgaacaaataaaataatgatgttgccatctgagaaagacttgggaatgatcacgtttgagtgtatgtgcttagaatgaaccagggttccatttttggattatgttgatagacagacacaaagggtatgattcagatattatttaccacttatacttgacaatctcaaattttggctcagtatcttgagaacatacacaaattaatttgtcacagggttttctaataatccattcatttctactaacatttcagaagtaatttccaaatcttaaagtttaggcttaatgacctaagacctaattccctaaatggccacgggaactagattgagttttcaccagtgatctctcaaggtcagctcagaacttaacaacattattgtcagtaggaagtaacttccccagtgattgttggaagcagcccagccttagaattaagagtcaaacagctgttcaagatgctgtgtgcgcagtaaactattcctccatagtatcacagacctgcaagcaggctggactattctagcccgtgcccttgatctcagagaatacaatctttgttttcaaagacttccagaaaaataaatctcaacacagagtttgttaaacacattttccccttatacactcaaaaatgttttttcattgactataattagatttttaaaaaaaaaacataatttcaggcctgaaatatgttcatttacttttcaattttacatcaaatttattcaatctcatttataaattaatattgttgttcatgttgttgactatctgaaacaatgaatggatgtatctgatacttcaatcccttatcttcacttttattcagaagtggagtgaaaataaggcggagctttttgtcatcttatttagatgattatttagtcaaactcatagaagcagagagtagaaaaatggttgccatacattgtaagggcgagttgttgctcaatggatataaagtttcagttatgcaagatgaaaaagttctagaggtctgctgcataacattgtgcctatagttaacaataccgatttgtgcacttaaaaatgtgttaaccgaggtccggagatcaagaccatcctggctaacacggtgaaaccccatctctactaaaaatacaaaaaaagaaaaaattagccgggcatggtagcaggcacctgtagtcccagctactcgggaggctgaggcaggagaatggcgtgaacctgggagacggagcttgcagtgagccgagatcgcgcaccactgcactccagcctgagtgacagagcgagactccgtctcaaaaaaaaaaaaaaatgtgttaacagggtaaagttcatattaagtgttcttatctcaataagaaaagatgattatggccttttctttatagcccagatacccatgttcataacttctgtaatactagctgtctcaaatgactattaagggaaacctctctttctgttgtttgctccattgcctctttcttcaaatttttttcttccatgaacccctatgaatttgctttagattactgggggcaatattcttgccaccctgccatgtacatcctggattgcttgcccttttccaagacctcgcttttaagttaactgagcattgcttgtcccgaagtgagcatttggtaaaatattcttatgtgtttgagactcaataaatatggtggctctttaaataaagaaggtccttttggtgacagaatatattcagcaactttcttgtcagacatagaaacaatacaggagacataaaaaataaggtagaaataacacaggaacaagaatgatgacgtaggatggcaaaactagtaaatacagatcaagttacagatatgactgttaacatcttgttctatgcctgctcggtatccatttgttgaatgaacagaactgttggatcatcctacatttcagagcctgtctagtgtcctctcatctcctacctaatcctgcagactacagaaaaagccccaagcagcagttcaaaccatggaacttctgagtgtttggacatgaaaatctcctttaagaaatcactaggttgaagaaggcaatgctaatgggaccacttcttgaggaaattccacccagtaactcagcagtgacactcagctttggatctggaacatgagtagacctagaataagatctgtccatttttcccaatttacagcattaattttttcacttatgattcatgagtccaggctttcccctgcaagcctgttttgcatctaaatcaacttggccttcatataacacactctagtgttctaactgggtgttctgtatcttagtcaacaatgtttactgagcatttactatatgccaagctatggctatggtttttaagcatcgataataacgatgcttagcagagactctcaaactgccaccatagagcaggcctgtggccgattaatgatcttaacaaattgattatagtatatgagaactggatgttagaacttagataaggttttagcaaatgcccacattttacaaatgaggacacagaggagcaggaagagtttatcaccttttctggatcactgcagccaggttctggcccagcccaggcttgaagcccaaggcttctgccactcagaacagtgctcttttcaccacttcagcctgcctcccaggatgattctaggaagttctgcttacaaatatgggtagtatttctagtcattccatcagattttattctgaaaaacacaaatttaccatttcaatatgaatacaggtaaaattcagcgccaggcaagctgtacatgattgaaagacatctgtgttttgaaaagcacgggcttttactcacatccatagtaatatgatcctaaatccactgtccccaggagaaagcaagatagcttttctccctgtcatgtcattacctatgcccagagttctcctcttgttcctctcatgaagcaaatcaatatctcacctttcatcccctccatacgtggttctgagctacttctatttatggcattatttagatatttttataatataagcaggaagcaagagggacagaaaaaaataatcagtggccaggtgtggtggctcacacttgtaatcccagcactttgcgaggccgaggcaaacggatcacctgaggtcaggagtttgagaccagcttgcccaacatagtgaaaccccgtctctactaaaaatacaaaaaattagcagggtgtggtggcgcgtgcctgtagtcccatctactcaggaggctgaggcaggagaatcacttgaacccaggaggcagaggttgcagtaagccgagatcgtgccactgcactccagactgggtgacagagcgagactccgtctcaaaaataaataaataaataaataaaaataataataatcaataacttggttcttctctattactttcaggaattttttaagtttctgatttcttccatggccattaggattttccacttatgtggcttccaaattattctaagtcagggagattttatgttttgttatcactcactttcagcttcactttagaattgcaagatttagattcaaagtgtgtaattaactgatggccttaggtaaaccctaacttatctgtatctcaatttgcatggatgaaacattcataatataaaagtatacaccacaaatatacctactcaaccaaactattggctccttaatgacaaagattaagtctctatatctttcctaactttgtacctaataggttcaaaataaatattttttgaatgaacaaattagtgagtcaacaatcagtcacccggttggccagtacctatggtgttttaagtgcaatctaccagataattcaaccttcataataaatagatttatcttgagattatcattgctataatagtgtagtagcatacttcatataagtttattttgtgaaccttaagaagctcaaggacaaacatctgtgtagtattcctaacattttctaaattgcatattttattttcatagaggtgctctacgtctttagtattgcttctaattctctcatatcactattttggacccttgggtctggctgtcttggaaaggtgaaaagaaaggtatggggaagaggatgtgttttaacaaagataattttatctgttcaagggattcaggaagtaattatcttaacatctgaatgctaacatctgaatattgtaaatacgtattctgtatgtacatgggagaaaatatctatatctgataccttttctatcatcacataaaggaactgacttctctggtttaaaatattaaccaaaatttatatgacaaaatcagtatatatgagtatatattttctcaaacctctttcaaacaggcctttttgggagacaagacacttatcaaaatcaaggctcttgacattaaatattcttgtttgtctttttttaaaaaaaagtcttcatttttctttcttttaaaatgcaataaattatactacaacatgcagtttatggtgagttattagatactgaaaaattggctttccattattttaatgcagattctacattgctttttttttactacataaagccatttgttttaagctccatgctacaaagaccacagatgttcattgcctagaacagtgtctgatacatagtagttgcttgaagtttgttaagtgactaaattaaagaggatcttacatataaccatgtttaaaattacatattgttatttatagtttttcccacatgataagaattattgccattttctttaacctctgacctccttgaaccaactatttctctctttttgtgggagttttatccttttgtatttaatctgaatcttttgaaattctaaagatacaatcacttaaccctctcttccatccactttcttttcttaatttcaggcaacaatgtgaaaataatggtgcttatgtctttgtaataacagaactttctttgtcttttctttggcctcattttaatcttcaatgactcatatttaagaaatgaactgtgcagctgtggtggatctaagtccttggcaacaactcgatgggcaaacacgtggtctctcacaatggatgctccttagctttgaattatttactgtccagttttaacaatggaattatatcatcaaatagtgccttggactttttaagtttttagtgccttaagtttttaagtttgatgagacctttaagatccatttccggccgggcgtggtggctcacgcctgtaatcccagcactttgggaggccaaggcgggcagatcacgaggttgggagatggagaccatcctggctaacacggtgaaaccccgtctctactaaaaatacaaaaaattagctgggcgtggtggcgggcgcctgtagtcccagctactcgggaggctgaggcaggagaatggcatgaacctgggaggtggagcttgcagtgagccgagattgcgccactgcactccagcctgggcgacagagcgagactccatctcaaaaaaaaaaaaaaaaaaaaaaaagatccatttccttattttacagaccttgttccaacaattatctccaccttctgtcaaggtcgtaacatatatctagggtgaccaactttcctcgttttcctgagactgtccaattttcctgaaactattctggttttaacatcgaaagtctctcatcctgaaaaactcaatgctggacaaaccaagatggttggttaccctactgctagcttccgtctttcactctaggttcaaatcattcctatgctaaaaagaacttcttatccctttgtcttgttatcctctctgtcctcctgtcgtgtcttcctcttttccttctcagaaaaagaaaattgaacatttgattttcacttgaaatacctactccttcttccactcactcctcagctatgcctacttctgaggcttctgccctccactgaaattgctctcagcacatctagtgaacactctgcaatgctgatcttactttacttctgtgtttcattggactcacttggtcaccctcttcctctcaaaattctcactctctccttgaaatttctacactcctcatttcccctaatctctccacctatttgttccttttctatctctcaagagatcctgttcctctgtttgcccattaaactttgatatgtaggcactcaacgtatattagctgaatgagaaaataactcctaagtattttttttctcctcaaacctcagaatttattatttccttgtggaaggaatgttagctttccaagctgagcatatcacagtcccttactctgtcccccatgcacagaacaccccccccacacacacacacacacaccatcatgttgcatttttaatattactcttcaataattttatcctgaatgagcatgaggggttctgaatcagaggcagatttcatttaattaccttacagtaaatattgttgctgtgcccttcctttgcccaaagacttacccctagggcaacatgatgaacgctgatgaaacattttcctacttgagtggctgggtactccataagtgggagactaggaaaaatcattttttctgcttataaaggagaaggaggctgctatccatctctcattctgaaaggttctctgtggaaacataacaggcctgagtcctaattccagcttctgcagaaaccagctagccctgtgtgtctcatgttttacaatctggaaatgtctccaaggtatgggcttcatattttttgaaatgtaaatacctagaaagatacccactccagtctttctaacaacatagagttcagcttaggaacctaccctgagctataaccgtttgaccctcttggatcagagaaatgaactagacaaattgctacagatctaatctccatggtgtgggaagtttctcaggaggctagagctttctgtaggtgaactgagacatccaggaaagtttatttcctcatacttagttgaattgcacccagcgtttgctcatctactcaacctagacactaagtgtcattcttgtttctttttctctcttctctccagcatctattcagtcaccaaattttcacacttcagatttttagacatttccctatcctatccctgtcatttttcctggtaccattgccctgagtcaaatcctcataatcttgcactgaattcttacaattgcctcattatctctctgattccatttctgttcttctcaaatacatactctgtatttatatcaggaagatctatttgaagcacacatattcctgtgccactcccttggttaaaaccgttcaaaggttcctgattaccttcaaggcaacacctaagcctcttagtggaccatatgtgatcatagagaggcagagcttcaaattctggtttaaaaatctaatgtatttccagatagcaatagtgtctttttcatctttggacatgccctctccttgttctttatgctctagaaacactggcctgcttgagattccgatacataccatactgcactatgtcctatgactctgcacttgcattttcctcttcttggaatgttctctagcatactcttccttgaataagtcatgttcatgcttttgaattctatgtgattactagcttctcctggaagcttttcccgattttcttccccatattgcgcaagtctatagcactgtctacattgtattgaaattatttacgtgtctgactcttctattatatgttaaatattcctaaatagaaagggctgttttgcattcaactttgtatttccagtttcaggtacaaccactgacacatggtagttcaatagagggagccattattatttttataattagtaatgtcagtattaattgcctcccttcaggtccaaacagagaaactaggcaaaatgataatttacttgaatttgggaaacttaattgtatgaaaaaaaacacaagaatacaacaactgaacacacacacacacacacacacacacacacacacacacacacaaacatggagatttcaagtgaaatatcaggagaatcagctttatatgtaagcagagtaaataactcacgtatctagcatgattttagggtacagaaatatcccattattcagaaagtacttccctatctgtaggctgaatcctaatattctacttacagaactccagtattttggttcaaacgccttccctttctctattgaattgtaaatagctgtggatgatgaatcattttgcaaagtatcagactcaggattcttttgaatggtgaacaccgctaagattttattaataaatgtgtcatacaatacagctctggaacacttctgtaacataatggcatatctgaaattcaaggaagaatactgctaatttgtttttccccagtgaaagaacagggcttaaattcagcaggcaacattgctaaaagacagagttgaaaaaagttacaaaaattaagccctagatcagggcaaatattactgttattgttaaacagttatattagcatttatgtagcatgcacttaatacttttattaataccctcacttctgagatcaaagaatctgggtcaataactctcttcaatggtgtcagagtatccgttaggttattctaggctcacggtatacctcacgatccttttagcactcgattatgtgtgaacttactgttttcactctgcttctagtgttaattttctcccttctttggatctagaaactttttgaaggcagaaactattcattttgtttttctcttgatcccctggataaaggaagattacagattaaagattaattctagatctgttcatttatagaaactagtgtccgcaattcctacatccataatagctcaaaacatttctactattctcaaagaggtcacaatggatgatgtaatgactatttttcaaaagtattgagacttttctcttagcttacctattttataccttgtcagacattttgacagaattaactggtgattgtcagttggattcattgtatactttaatatagcctaaggtcctgcaaatggcccttaaggcttcccattatgttctggatatccactatttggggtatgtttaagtcctcattagccatgctagagttttgcaatatataccttgaaactttagctgtagatttgaagtatggctgtcaggttacataaacaaagcactcttatctcaatgagagggcattaactatccagaatgctccccccatctccccagaatagctttacaaacacagcgctttcctcattaacagatagacccatatagcctttaaaaaaaatcattttataaccatcagtgtataaataaaagagatagaaattgacctgggagtttcataaacaagttctgagcacccaggattaattttgagaagaatgccacaagccaaataagcacttcttttcatctcatttcacaggccttcaagagggaattgaaaactaaagaacctgtaatcatgagtactcttgagactgtacgaatatttctgacagagcagcctttggaaggactagagaaactctaccaggagcccagaggtaattgaatgtggaactataataacatattgatagaaggatcagtggtgacggagcagcccatccattcttgctgccagggtctggatagctctcatattttcttggttaaatagaatcaattcaaattaaacatagatgctgaaaaaaaaataaggactcataaactaccatgcataaatcagtttgtgcattcataaataaacatcaaaagagattagcaatcagttattggaacatttagaaaataataaacaaagggagttatctgtgaggaggaattctattgttgcaaagactacaagttaattttccatttaagagcctgcctgaagtaaattagagcttgtggtatgcatcctaacgtttttctcctcaatagcttaagtgaatcttaaattgtcggattgatataaggtagaaactcaggaagatatactttagatgttctgggctgtatcaaaatttatgccaaagtataaaaaagccgttaatcagtaggttaccctcttgttcaactgtactctttctttcttccagtatgacctttttgacaatgtttaaaaaaaaagaatgtggcctaaaaccttgtcatattgccaatttagagctgcctcctgaggagagagcccagaatgtcactcggcttctacgaaagcaggctgaggaggtcaatactgagtgggaaaaattgaacctgcactccgctgactggcagagaaaaatagatgagacccttgaaagactccgggaacttcaagaggccacggatgagctggacctcaagctgcgccaagctgaggtgatcaagggatcctggcagcccgtgggcgatctcctcattgactctctccaagatcacctcgagaaagtcaaggtaccgtctacttctttgcttcagggccctttgagagactcaaaagagcttctaatctgaacttgagtgcagtgttatcttcccacaaagttaaagctagagaaatcagtccgtctttcacaaattcagtcttcattcacatggtattttctccaagagaagacagtgatctaattatttgtctgtcttcagttatatgaaatgaaatattaaaacagttacagggcaagaaatcactttgactttgatattaagtgattgtactaaagtctgatgtgtgtgtgtgtgtgtgtgtgtgtgtgtgtgtgtattggtgtattgcttgtgttacttagtatcagaatacagaaaaataaaacacttaatcaaaagccaggagtctaggtgttggcccttttgctaaccaaattacatgacttgggtaagttatggtttggtgaaataaggctgttaatgtgttgcccttcccttggaaggcaacatttgtaatacagtttcaagtttcattggcccactgcagaaatgagggaaaatcattatatatttggaagaccactgtctataagaccaaagttaaattcccttgtggcacaaagatggcaaatatattctgtagaaaaaaatacatatttaggagtatcattttgaaatcagcaactactcatctattgtcaaaatcacaaaaatcctcctagattaaaattcaaaagaagttaaattccctcatgcactcagcatgtttgccagcatctcagcatcctcattctagaagttgtcctcttccttggctttcatggaactgttccatccatgttcttcttcctatatttttctagattcttctcctagccacccctcaaatactgttgtgcccaagtttctaaccttagcctaattctcttttgattgtttaaaccctccctgtttgagatggcctggatggtgatgtatctacatctctagtccgcatctctcttctgatctctgaatccatgtggcattacgatcacaaatgcaactattctgaaaccaagttcatttgttctcctgttttccatttccctacttctgtcccctcttatctgaccttttttttcctgtttcctatttcagttaatgaatcatcatccaacaaattttccaggctagaaactttaggttcatccttaaacccttctgcattttcactgatggcacatgatggctcatgttacctcagaatagctcttttgtgttttctctcctcttttaaccaatgtcctttttaatccccagcatcttttacttagatgataacagtatacatctttaaatcccattcacccctctgtgtgcctggcatatctcagatactgcattttaaacatttggtgaattaatggatggatgaatggtttctttgctgatgttcctgcattacccagcttcttccaattccaatccaaactccttgcgggagaatacttgcctagagaatgaaatccaatgaataaggagattacgtggcccttttcttcctagccttgacttaccttctcagccatagctcctattctccagaccatttaatacactctgcccatatgatatatatatatatgtgatggcatatttgggaaaaaggggtgatatgggcagagtgtattgaatgtgtgtgtctgtaaagtatgtgtgtgtgtgtgtgtatatatatatatatatatatatacacacacacacatacatagttagatatatacatagtatatatacatatatacatagatatacacatatatatacacatagatatagatatagatatatctgcctttgcaaatgctgttctctctgtctggatccccctacgttgtctacttggcgaattctccttcagccctcaaggaccagccaaaatgttacctatctttgttgtctttcctgagtgtctacaacccccaactcccaccaagcagaagaaactgcttacagttggtactctcatagatcaccaagcatgctaaattgtcacacttaaatttcacatatattgtagcaacttgcttatgcatttttttttctcccagagaaagtgaagttgctaagagcaaggatcatgctgtacatctttgggctgctagcccagggccagcaacatatgaggaatctcattaggtaccttcatttattcactcaacaactgtttatgagtcattatataatgtgctggacaggtagttataaaagaaacagacttgatcattgccttcatgaagcctatggtctaatgttgaattgcatagctcttcattaaaatagtaggtaaaatttttaaaaagaaaagattaaaaatttgactctaatacttgtaaaatcccttctaccccaatgttttatgaccccatgtctaacatttaaagtaagggttaaccttgctgtgtactggaaaactaagggttttgaaatgtattacctagtattttaaaagcattaaatatgttgattttattcaaaaatatagggactaattttttgacagacttctccaaaaatgagaaataagttaggaaaatgtcccagtggaactaaattagttaatatgtcaattaaattgctcaatagataggctgtagagcagacataagggattcatttttagccatacttgtcacacaggtgcatttgtaagatactgagtatggatggagaagagaatgtgtacagcataatttaataattaaaaataactaaaagcataacagttcaagtatcagctggccttcacccaaccctatttgcggtattccttttagtttccctgtcttatctgttcttggtcttaagacaaacttcattttccataccctgattggtaaaactctcattctgatcccaatgatagcaaaacatataaacattaaacatacctttcgaaaaattatatttataacccagcacatctatctttctcagacatatatacacttaagttatggtacttatctgaatttttatgtactggtaatagtagatgtgattgggcttttgaatctgtgttgtattttatgcgtgtttcaaactatgaattacatgaattcatatatatttatctcccttcggtagctcttctttaattttgcagtggaaataaatcatttttctccactgcatcttattgacactgggtttgaaactctgaagctttgggggtagtagtttacaaagaatgagttttattaactaaaatttatttcagaaaaaaagtagaagtgtacttgaaaccactcttcccatttttccactcagcaatttaagccctcagaggattcatgctgtagggaacttttctaataaaccatggtttctctttttttattttattttattttattttattttattttattttattttttttttgcgacagtctcgctctgtcacccaggctggagtgcagtggtgctatctcggctcactgcaacctccacctcctgggctcaagcagttctccgcctcagcctcccaaatagctgggactacaggcgcccaccaccatgcccagctatttttttttttttgtattttttagtagagatggggtttcaccatgttggccaggctagtctcgaacttctgacctcaggtgatccactcaccttggcctcccaaagtggattacagcactgataactaggcagctagctagaagaacattttatatatccatatcagttcattttccttacccctagacactctatcatagtaccccccctccattctgatcttatgtgttaaataacttgttattcaagaaactaagtaatatgtgtttctgtgagatttagcattctgtaattgtattagcaaatgtggcttttggatttaaagaatgggtgaaacaacaatgactaagtccctggcctttatggaaatggcattattgctagctgatcatctgcgggtggtgaacatggtaaattaataaatggaaacacaatattaatattgactatattgctcactaagagaatctcagccttccaaacatagcttccataggaaaaaacagtagaatcaaatttaagttttaaatgcttctttacttttaaaattcatgatttatactgcttatcaaatattttaagggcaagatcatgacttttcactttactgaaaatagcaccagtgcttatttgactagacaaatattctaccttccttgtaatggggaataggaataactttttgaattactaggtgttccacatagatctgtaagtggaatatataaaggctttaataaagtagaataacttttaaacctgtagtctggatacaagatttttgttcttcaggacaatcccaaggtgaaaaggtttgtggattgttgttttctttttttttttttttttgagacagagtctcactctgtcaccaggctggagtgcagtggtgagatctcggctcgctgaacctcctgggttcaagcaattctcctgcctcagcctcctgagtagctgggactacaggcgcgcaccaccacgcccagctgatttttgtaattttagtagagacggggtttcaccatgttggccaggatggtcttgatctcttgatctcgtgatccgcccaccttggcctcccaaagtgctgggattacaggcgtgagccaccgctcccggccagattgctgttttttaatgttttgtttttgttttaataaaccatggtttctctttttttaatttttttttttttgagacagtctcactctgtcacccaggctggagtgcagtggtgctgtctcggctcactgcaacctccgcctcctgggttcaagcaattctctgcctcagcctcctgagtagctgggattacagacatgtgccaccacgcctggctaattttttttttttttttggattttttagtagagatggggtttcaccacgttggccaggctggtctcgaacttctgacctcaggtgatccgttcaccttggcctcccaaagtgctgggattacaggcgtgagccactgcgcccagactataaaccatagtttctctgtaccaaaagtggtatgtccttcttgagccaggaatatttcactgttcttagtttacctgttgactctgaacacagtttttcatacactgtaaataactctcccaggctgccatcttggaatatgcaaatctgtcgcatctatgtagttatgcatatcgcatttttgtcaaacttttaacttgcatttcttactgtgaaaagtcagggcagggattctatgagttttttctttaaagttcctacaatgaaatgttttgattaaaccttttttggcattcaaattgagattgatttaatgatgtgtgtagtaggctagaaattatgatgaagtgacgatgccatccttatttatcttcagcattcacatctaaagttttaagaagaaaactggcaaatccacctttttaggcttaccatcctcagtccctgtggctttgggtttttttgagaaatttgtcaaagaaacgctatgttagaatttgacattgaggaagccaagcatatttcctctgaatagataatgtgaaatgtgatataatgtattagaatttcatcttcactttggcaagcaagatacttgcaaccatgttcatgcaactatcttcccttattgcttttctcttcttaaccttggttctaaagttttcttcttattgtattaattttgttatgcttcccatttatatgagtcaagtcaaccttacttgatttcttatatatgagttatgtaaggaaaacttatcttttcttatagaattaggggatgaatgagcagatagaaccaacatgaacagggcgatcctaaaaatcattcaaaacatgtaagctctcccaactctgaataaacttgtgatatcttcataatgaataaggtatactgcctatagtaggaagaggaaaatttattaatgttttgtgcattgttaaagaactacaaatgaattgccgtgtggaggctttcattgttgttgttgtaaaaatgctatgtgtattaagtaagcctttgatggagaagaaaaaacaaagaaaaaatatttaatccttcataaatctgggttaaatatgaagctaattcctgttatttggagtaaccagggttttatctagtttacaaagcatgcaattgcaatgtttaaaagcatatgatttggcctttaatatctgaaaatatgtctatcaaaggccatattatagcgagtgtcactccatactttataagtacggtatatttttaatagaatgtttatgtactggtgataagagatgttactgggtttctaaaccagtactgtattaaggattttatgctattgtaagattatggattatgtgaattcatatatattgatttactttcagtagcttttcaatagaatatctagggtttaatacagcttagaaactaaagcaggaattattcatctttaaaatcctgaccaaagaagtggctggcaagatggctgaataggaacagctcaggtgcgcagcccctagtgagatcaacacagaaggtgggtgatttctgcatttccaactgcagtacccggctcatctcactgggactggttagacagtgggtgcagcccacagagggcgcagaagcacggtgggatgtcgcctcaccccggaagcacaaggggtcagggaattccctcccctagccaacagaagccgtgagggactgtgccctgaggaacggagcattccagcccagacactatgcttttcccacagcctccgcaacatgcagaccaggagattccctcgggtgcctacgccaccagggccctgggtttcaagcacaaaattgggcagctgtttgggcagacaccgagctagctgcaggcgtttttttcatatcccagcgtcacctggaacaccagcgagatagaaccattcactcccctggaaaggggactgaagtcagggagccaagtggtctagctcagtggatcccacccccaacggagcccagccagctaagatccactggcttgaaattctcgctgccagcacagcagtctgaagtggacctgggatactcaagcttagtgtggggaggggcacctgccattactgaagcttgagtaggcagttttcccctcacagtgtaaacaaagccgtcaagaagttctaactgggcggagctcaccgcagctcggcaaagccactgtagccagattgcctctctagattccttctctctgggcagggcatctctgaaagaaaggcagcagccccagtcaggggcttatagataaaactcccatctccctgggacagagcaccacggggaaggggcagctgtgggtgcagcatcagcagacttaaacgttcctgcctgctggctctgaagagagcagcagatctcccagcacagcactcgagctctgctaagggacagactgccttctcaagtggggtcctgacccccgtgcctcctgactgggagacacctcccagcaggggttgacagacaccctcatacaggagagctctggctggcatctggcaggtgcccctctgggatgaagcttccagaggaaggaacagacagcaatctttgctgttctgcagcttctgctggtgatactcaggcaaacagggtctggagtggacctccagcaaattccagcagacctgcagcagagggttcctgactgctagcatcaacatcaacaaaaaggacgtccacacaaaaaccccatctgaaggtcaccaacatcaaagaccaaaggtagataaatccacgaagatgaggaaaaaccagcacaaaaagcctgaaaattccaaaaaccggaacgcctcttctcctccaaatgatcacaactcctctccagcaagggaacaaaactggatggagaatgagtttgacgaattgacggaagtaggcttcagaaggtgggtaataacaaactcttacgagctaaaggagcgtgttctaacccaatgcaaggaagctaagaaccttaaaaaaaaggttagaggaattgctaactagaataaccagtttagagaggaacataaatgacctgaaggagctgagaaacacagcacgagaactttgtgaagcatacacaagtatcaatagccaaatcgaccaagcaaaagaaaggatatcagagactgaagatcaacttaatgaaataaagcatgaagagaagattactgaaaaaagaatgaaaaggaacaaacaaagccttcaagaaatatgggacgatgtgaaaagaccaaacctacatttgattggtgtacctgaaagtgatggggagaatggaaccaagttggaaaacactcttcaggttattatccaggagaacttccccaacctagcaagacaggccaacattcaaattcaggaaatatggagaacaccacaaagatactccttgagaagagcaacccaagacacataataatcggattcaccaaggttgaaatgaaggaaaaaatgttaagggcagccagagagaaaggtcaggctaccccaaaggaaagcccatcagactaacagcggatcatttggcagaaaccctacaagccagaagagagtgggggccaatattcaacattcttaaagaaaagaattttcaacccagaatttcatatccagccaaactaagcttcataagcaaagtagaaataaaatcctttacagacaagcaaatgctgagagattttgtcaccaccaggcctgccttacaagagcttctaatgaaggaagcactaaatatggaaaggaaaaactggtaccagccatggtaaaaacataacaaattgtaaagaccatcacactatgaagaaactgcatcaactaacgggcaaagtaaccagctagcatcataatgacaggatcaaattcacacataacaatattaaccttaaatgtaaacaggctaaatgccccaattaaaagacacagactggcaaattggataaagactcaagacccatcagtgtgctgtattcagaagacccacctcatgtgcagagacacacataggctcaaaataaagggatcgatgaatatttaccaagcagcaaatggaaagaaaaaaaaagcaggggttgcaatcctagtctcagacaaaacagactttaaaccaataaagatcaaaaaggacaaaaaaaatggtattacataatggtaaagtgatcaatgcaacaagaagagctaactatcctaaatatatatgcacccaatataggagcacccggattcataaagtaagttcttagagacctacaaagagacatagatgcccatacaataatagtgggagattttaacaccccactgtcaatattagacggatcaacgaaacagaaaattaacaaggatattcaggacttaaactcagctctggaccaagtggacttaatagacatctacagaactccccaccccaaatcaacagaatatacattattctcagcaccacatcacacttattataaaattgaccacataattggaagtaaaacactcctcagcaaatgcaaaaaaacagaaatcataagagtctctcagaccacagtacaatcaaattagaactcaggattaagaaactcactcaaaaccacacaactacatggaaactgagcaacctgctcctgaatgactgctggataaataaggaaattaaggcagaaatgaataagttctttcaaaccaatgagaataaatacacaacggaccagaatctctgggacacagctaaagcagtatttagagggaaatttacagcattaaaatccccacaggagaaagcaggaaatatctaaaattgacaccttaacatcacaattaaaagaagtagagaagcaagagcaaacaaattccaaagctagcagaagagaagaaataactacgatcagagcagaactgaaggagatagagacatgagaaatccttcaaaaaatcaatgaagccaggggctggttttttgaaaagattaacaaaatagatagactgctagccagactaataaagaagaaaagagagaagaatcagacagacacaagaaaaaatgataaaggggatattagctctcatcccacagaaatacaaactaccatcagagaatactataaacacctctacgcaaataaactagaaaatctagaagaaattgattaatttctggacacatacaccctcccaagactaaaccaggaagaaatcgaatccctgaatagaccaataacgagttctgaaattgaggcagtaattaatagcctaccaaccaaaaaaagcccaggaacagatggattcacagctgaattctaccagaggtacaaagaggagctggtaccattccttctgaaactattctaaacaataggaaaagagggactcctccctaactctttttatgaggccagcatcatcctgataccaaaacctggcagagacacaacagacaaagaaaatttcaggccaatatccctgatgaacatcaatgcgaaaatcctcaataaaatactggcaaaccgaatccagcagcacatgaaaaagcttatccagcatgatcaagttggcttcatccctgggatgccaggctggttcaacatacagaaatcaataaacataatccatcacttaaacagaaccaatgacaaaaaccacatgattatctcaatagaagcggaaaaggccttcaataaaattcaacaccccttcatgctaaaaactctcaataaattaggtactgatggaacgtatctcaaaataataagagctacttatgacaaacccacagccattatcatactgaatgggcaaaagctggaagcactccctttaaaaaccggcacaagacaaggatgccctctcccaccactcgtattcaacataatattggaagttttggccaggacaatcaggcaagggaaagaaataaagggtattcaaataggaagagaggaagtcagattgtctctgtttgcagctgacatgattgtatatttagaaaaccccatcgtctcaacccaaaatcttcttaagctgataagcaacttcagcaaagtctcaggatacaaaatcaatgtggaaaaatagtaagcattcctatacgccaataatagacaaagagagtgccaaatcatgagtgaattcccattcacaattgcttcaaagagaataaaatacctaggaatacaacttagaagggatgtgaaagacctcttcaaggagaactacaaaccactgctcaaggaaatgagagaggacaccacaaacaaatggaagaacattccatgctcatggataggaagaatcaatatcgtgaaaatggccatactgtccaaagtaatttatagattcaatgcagtctccatcaagctaccattgactttcttcacataattagaaaaactactttaaatttcatatggaaccaaaaaagagcccacatagccaagtcaatcctaagcaaaaagaacaaagctggaggcatcatgctacctgacttcaaactatactacaaggcttcagtaaccaaaacagtatggtattggtaccaaaacagatatatagaccaatggaacagaggcctcagaaataatgccacacatctacaaccatctgatctttgacaaacctgacaaaaacaagcaatggagaaaggattccctattcagtaaatggtgctgggtaaaccggctagccatctacagaaaactgaaactggaccccttccttacaccttatacaaaaattaactcaagacttaaacataaaacctaaaaccataaaaaccctagaagaaaacctaggcaataccattcaggatataggcatgggcaaagacttcacgactaaaacaccaaaagcaatggcaacaaaagccaaaattgacaaatggaatctaattaaactaaagagcttctgcacagcaaaagaaactatcatcagagtgaacaagcaacctacagaatgggagaaaatgtttgccatctattcatctgacaaagggctgatatccagaatctacaaggaacttaaacaaatttacaagaaaaaacctaatcaaaaattgggcaaaggatatgaacagacacttctcaaagtaagacatttatgcggccaacaaacatgaaaaaaagctcatcatcactggtgattagagaaatgcaaatcaaaacacaccagttacaatggcgatcattaaaaagtcaggaaacatcaggtgctggggaagatgtggagaaataggtgtgcttttacactgttggtgggagtgtaaattagttcaaccattgtggaagacagtgtggcaattcctcaaggatctagaaccagaagtaccatttgatccagcaatcccattactggttatatacccaaaggattataaatcattctactataaagacacatgcacatgtatgtttgttgcagcactgttcacaatagcaaagacttggaaccaacccaaatgctcatcaatgatagactggataaagaaaacgtggcacagatacaccatggaatactatgcagccataagaaaggatgagttcatgtccttggcagggacatggatgaagctggaagccatcaatctcagcaaactaacacaggaacagaaaaccaggcaccgcatgttctcactcgtaagtgggagttgaacaacgagagcccatggacacagggacgggaacatcacacaccggggcctgtcgaggggtgggaggttaggggagggatagcagtaagagaaatacctaatgtagatgacaggttgatgggtgcagcaaaccaccatggcatgtgtatacctatgtaacaaacctgcacgttctgcacatgtatcccagaacttaaagtataataataataaaaaaaaaatcctgaccaaattatttattcaatgtgaaattaattgtaagttagtgttgccaggagagcttattacttagttaccatgtattccctctcatctcctgctttgtttataaagctaaaagcaaattacttaggacagcaatgtcaaatcactttctttccccaaagcatctgattttagatagcgctgtgtgtgttttaaaagcccctacctcgacttaggcaaacagaaccttcgtttaccatgctattcccatcccgcctttgaaacttctgaaaaggcagagcggagtaattgtttcagacatctgcttagcatactttgaagtgcatataagttctttttcagtttcatttgaaccccagctgtcttcaccgaagtctataatcaatctgaattaagttgtcctacttctcctaataagtctcttattaagttctgcatcagcctcttagggagacttaaaagctaattcatgtagaattgccattttctactaattcacttgtcagctctccaaattccaacaaaaacaattgcaaagactattaatttggctcttcataaacaacttatgtaagtgtagtatacattggaaccaaacaaacgatttaaaacagtgggtgggaggaaatgagttgatggcattcaaaacgcttccttttttgactgttatgaaatgccttccacatcgaaagcataaagccatttatttaataagggaaacatccttctgcttttactttcatagatgagataatgactgaatgaactttgcttaaagacaggaaaaggctttagaacagttggaaaaggaacatgttctttttgtcattgaacttattttaatttggacttctttgtgttattttgatggactgtgataaaagaaggagctagaattggttattattgttattggattaaatcagagttgtacagctactcttctggtcatgggatatttaggagaacacgggtaatcaaaatgttcagctaatgagttcatctgattctactcaagaagtgtttaatcagataataaaaatttctccaaataataccatccttcctactatttgaaaacaaccatatcaacatctgatcctataatatgccaatcctgtttgctaggattttctgaaagctttgtttgtggtgggtaataactagaaatactattcctcaagagtctcgggtaataaaagattattcaaaaaacttaagtaatatactctcagtattagaggatatacaaatgcactcattcattaattcatgatatgattgaaacctatacccagagaagtctgatctcattatagagtgtgaacatttaatttatttcaaaaacaaaaattatattgagagttgtatagatggcatcttagttttcctgggaatattattatttagcaccaagctgagggagcaagaatttgtattagcttgtgtatacatgtgcatgtaccacattaactagaaacagtgctaaaatgtgagttatttatttaactgaaattccatatttcctaagaaaatggaatcacacagccaatatatatttttaattattttttgacatctaccaaagttgtgacaagaataaagttcacaattctgttactctcctaccgttcagtaaaacaggaaatgctttaagatcaaataacccaaggagttcgcttcttcctgtcatgcttgacaattacaattttcaaaatttaacagttagcattgacaccagtattatgccttacacaacctgaaattaactaagttaagtaatggcattgaataatttttcttggtaaatcagttttctgggtattatgggaacagttgtgtctgtgatactaatgtctctctcattttaatggggcctaagaaagaactttttcataataagattttttcatgttaaaataatatttttagttatagtttacacttactgcaggtttttctatttaaaagcatcttccgagagcagtgattcttaaacttatttacttcagttatcttaacagcatagaagacatagcctgacatctcccgcttccacttacctatctcctttttccatgagcatgaaatttctttgatgttcttgttttattttttaaatctcacatcaattttatggtattttccataatggattcatcatgttttaatatgaagatgctttttcttcaaattctgaagtaaggaatctttcagcacattcacctatggacatgaaagcgtaagttgagaatcacagtataaaggattgcccagtttttgcaggctttatctttttccatcaacttctgtcttttatgtacacagacaaaaagagcagacccttgctatttcaaatttatcttttgcaggttcatctgattattgtgatccaaagttccatgactagcagctcttaattttgaacatgtattatttcaagcttttgtgcatagtcacttaactaatgagttaaatggcattttaagtcaggttccatgaacgcagaccctgagaacaggggtctaggtgcctgtgatttatagagggtctgctctcaggagaagcctgtattggagttagggaaacaatacaggagaagaaagagcccagcaagtatgccatttcaggtgaaacctcacattgtgtctgatccagagagagagcaagccctcgagcagaaacctcgctgtggagttgtactctttattttattttatttttttgagatggagtttcgctcttgttgcccaggctggagtgcaatctcagctcactgcaacctccgcctcccaggttcaagtgattctcctgcctcagcctcctgagtagctgggattacaggcatgcaccgccacgcctggctaatttttgtgtttttagtagagatggggtttcaccatgttagtcaggctggtcttgaactcctgacctcaggtgatctgcccacctcagcctcccaaagtgctgggattacaggcgtaagccacaacaccgagccggagttgtgcctttataccagtcattgtctgtgtcactgaagtgctggcaaatatttgtcgactagctctgaggtgggatgaatcctggtgtgtatcaaaaccagttttcgtggtgtaaatactccctctaccactgatctccagctaccgacataatgccactgagtatggaattgggaggagatgcacacaattggctcttgggctctgctgcagcacaccactggctgtggtccactcctgggatatgggttacttcctgggctagggggctcccataagcagaggtcacatgtggagaaggcaggtagctataagacattaatagtcaaccatcacagcagctgaaggatggatgcccaggttaggtaaagtgtcccctgcaactaataagtaaacctagtaatccactcactcttcatattcaacttggctttttttaatgctgttttgtttttgcatgtacagtaattctttataaataatgagaattttgtttctttatggaaaatccacctaccctccaccctaccatgaatagcttgatagctgttcatcagaattagtgatggaagagaagagttaatgaatgaaaaagtctaagaaagtgatcactattagtaagaaaatggcctcataagtgagtttggctttatagttatggaatctgtaaatgtctaggcattcagacatgtccagacatcattgagaatgtcaagaattttcagtggcaatggttctcacctcagcatacatcagaatcacctggagggcttgtagaaactcaggttggtgaaccccttccccagagttcctgattcaaaatgtctggggcaaggctaagaagtcccaacttgttcccaggtgttcatgatgctgctggttcagagatacattctgagaaccaatattccatagtaaagctactgtgtatgtacctgaagacatattttgtgtagtgttagcgtttcttcaattacaagtaataaatatatcatttattatttcttttatatttatcaatatccagaagatttagtttaaaaatgaatgcaggcacacagcctcttgttggattgattaatagtttagatatgggagcatcatagggagcattgtttcgcttaggaaccttgaaatgaataaatggcttcttttctaaatctcacttgtggaagactttgacggtggtttatttcattttttcctgttggtattttaatgacactggtacaattttggggttgcttcagatgaccaacagcataacttgccttcccagtattaatttttaacgttaaaaatatttagtcatggccggccgtggtggctcacgcctgtaatcccagcactttgggaggccgaggtgggtgggttgcatgagctcaggagtttaagaccagcctggacaacatagtgaaacctcgtttggacaaaaaatacaaaaattaaccaggtgtggtggcatgtgtctgtagtcccagctacccgaaaggctggggcaggaggactgtttgagcacaggaggttgaggctgcagtgtgccctgttcactccactgtactccaggctgagtgacaaagcaagaccttgtctcaaactatatatatatttagtcacataacttttcactttgtgtaaatattttttgcatttaccaataaaaacaattacatttaaaaattctccttacacttttctaccaaacatactgatgataaaatagtactttatagagtttctgaatctaggatattaaaaatagttgggatcagtcaacactttttaagtaaaatctacttgctagatatgaatagctaacagcttctccaggagtgcctacattttataacttactttgtccaccccttgaggctctgtgttcagggggagggtatatttttgtgtatagaaatagagatgaggtgaaatagagatgaaatagagatgatgtgggatcaactgggagaaagtagaaaagagtcttagctgaagtggttgaggaaggaggatttttcccaaaatggtgcaaaaaacaatgtattaaatatctgtgaaaaagttcatggttgtggtatagggtgagtggtatatgaaaagagaattatgggataaactaatggaaacagatgtcttaaaatttgcttttaactttaaacaagagacatgaaacttaaacttttcccttatcctagaatctgggagaggagaaggatgagaaaaaatgaaattttacattagaagcaatttgattaatgttcaatggaaaatggaaatagctatggtcaaacccactcaaatcaagtgtacattaaataattgagttaactgaattaggcagagtaagggcacattgattttcagtgttgttgaaaattggtccacatatcattgttatgctttttgtttgtaaacctcaatatttattaagtttccacagtgtgctcagccctgaaacgccaaattctcttaaccagaatgaggctggaggatctaacactaagacagatttctattttcttttaaggaattgatttttatggtaattttttttcttcataaagttaagaacctgccagtcctgtttcgaaacacacttatttttagaagtttggttttccgggattatgcatcattatagactcaaatgactcatttagaacttttccctatcaaatattcacattctatcatcatgatcttaacacggcataagcaagttagtgaacagagtgaagtcaatttattggcaatatatgccgaagtacaggaattaagtagaaacaaaagtgaatgagagtctttggcaatacattgatgtgttttttttagaaccaatgataaactactgctgagtttcctttcatttacttttttcctactcttaaaacattgtaacccattttgagatctatccattgttgtgaacctaaagcctattaggtcttattaaataatacccatttaactgacctgtgatttaagtttcttatctgcccccaagcaagcagactgtatgcaacggcattttacctgcttcaccttctgcttgccagttggtttttggtcttcacatgtttctagcagggatggggctaaagcaagggagagaatggtccattgttttagactttcacaaacccaatatactagaatctccacaaaggttatccaatatcagggtgacttttgtgcatccaataaagcataaggttaaaagaaatacaggctaaacaaatgagcataaattactccgttggcttatgctgtgaataaaatattacctttggaaccatctcaattttttttttgtataaaggttgaaggaagacatttgcaaagtcgtttctcctataaaactgcctagggtttggggttgattgttgtatgcaagaggggtcttggtgaaatctgacccactttgaatctaaaattactgaattattagtgaaaagattattttaaaaagagttttgaactctttttcctactgaaattgtattctcctttagataatcaatgcagcatcacccccacagatttttgagggcactaaatcatactcctattttgaaaaagaaaaaagtctattactattaaatatatctgttagttgaatatcaatcactttttctaaagggtagatttggccaatgagtgatttttttttttttttttttttggaaatcacatctgagaacgttgtttagacagcttgacacttagactcatttgtgtaagtagtaatttattcatcatttgcatgtacttaactggacattatcatgatagcagttgtcataacagactattacaggatatgaatttagatattaccttaagatgtgatcataaaaatcagaataatatcttgaaaatatcaattttatggtgagaaaaatgacaaactgaataaactcttgactcaagaagctagacttttcacaacctcatgtattcacagaagtaaaaataacaactaataatgtgtccagagggcccacattgctcagaaatgaatacataagactttcttttcagcctcagaatatgatgaaaagaagatgaaccattatgatgttgcatagattttaatgaagaaaattcgttttctgttcctttcgtttgactttaagtagttgaacatcctgcttttttattttgtttgcaagaaataagaccattttagaaaggctaaaaacattaattacatttaggaactacaataatctgaaagtaaaattggatattaaaggacgtttttgcaatcctttttagccctcttctgtgtattatttttatcactgctcttaaaaatttgtattaatctttggttcatttctgccttagtatttctaagttaataatatattgaatgaaaaatcaaatcagtaaaaatccattttgtttcagtagtgagtgccttccccctagaaccaaaactaaataaatgtgctccatataaagcaaaccaggtacagcatattgcacgggtaactcacaattctagattcctctattaatcattattcagacatgcagaggtagcttaatttgctttaataagtgaaaacagaatctctttgagactgctatctgcaatattatactttgtcctgcattttcttggtcaaaaattgtattttatagccatgatatattttggcttggaatttgcttctttataagcctagttattaatagtcatcatttaaatgaaatgatatccattagccttaagctgcatgattacagagacttggtctatcttacgctgtatttccagtgcctagaacattccctggcatataataggtacccaataatagtttttggaataaatgaataaacaaatttgtgcaaaagcatagggcaaaatgctatcttttagatagcgtgacccttaaaaattattttgcaaataatttgctccatttgccaccagcttatttctggccattgttacttcttgtctctgcatacaaacactctgtgtctcttctcctttccacaatgaccacaagttatactgatctacttgagattttccaggtgactatttcatgtccagaggaacatgcctcttctagtgttcccctctgtgaatgatttcagtcaccttatctactcaggaggtctctcttcccctccatcagcatctttctctgcaccttccaaacccctatgactcaacttctcataatatggattgcattttttttaatgacccattaaattgtgtacctctgctaatgattgtgagtgtgttgagacttccatttttccagtggatgataggtatataatatatatatatatacacacacacacacacacacacacacacacacacacacacatatatgtgggcacagtatctagtggatataaagtaagtgttttcaagtgagtagtaattaaatctaagagttgccgagaaaatgccattcccgttttgtggacatcttcattctacattgtaaaggccacctcattcaagacccaccacaatcttgatcccagaaaacacccatgattcatcttttacagctgccctgtacttcatattttaagttattaaaggctatttgcttttcctcagacacacattaaactttcctacctcttaccctttgttcaagttctgaacacatatctttcttccccacactatgcttcctctttatcagtttcatgtacctactttccaatgtctagttcgaggagacgtttataaggctacatgatagaggttgcccctggggcgatgtgagaaatcagctccaaaaaggtagctacccggcaaaggatcttagtctgtgactctctcatggatgaacttattacctactgctttgcagagtctccctggactagcctgaataggaacttgtgtgactatatgtgaactaaaagaaggagaaatatgcctaaacttctcatccatctttgtaacagccctaaagtatgcatgttactatcccttttctacacaagtggaaaatatttgtaaatgaacttcgttacagtctaatatttgatgacttcttagttcatatcattatttaagtaacttttctttagtggaaaagcccaaaaattagggaggcagggagagagagagagagagagagagggatcatctgtaatctcagccccagcatctataatcccaatccctgcaagggcctctttgggcaaagaagaaaaaggcactgtgtttttgaagagatccccggtcctatgccaagcctaaccaatttggtagtagagcccaggctggatttcagttggtttgtagtcttctagtcttttcatatgtaaatatttttaatgcttttattcagtgttgttaaaatgccctccaaaagatgcactaacttgtgccaccaccaccaagcagaatatattttccttgaataggctacttcctctttttttcccactcactccatttttattttaaaaatccctggtagagaccaaaaactgaaatgttatattcttgcccaaagaatgagagatgcttcagaaattagcaaatgctccaatataaatcaagtgatagatataaataattcagatatgggataaggaaaatgggtagctttctcttatttaggaactctatgtcaggtttctgtgagaaactgtttacgaagcagtctgacaatagctattggtctgaagtattagtaattagtacagaagtgcctaattctcttgactgcttgttctttaataaaaatgtattgagggattatcatgtactatggcttggcatatactggtgaaaaacaataatgtaggattgccttaataaattttctggtcttgggaaggaacagacaatgaataaatgaataggcaaatatatatgtacttgcaaattgtgatcagggttcagaaggaaaatagggtgttgagagtcaaggaaaaaggagacactttacgtagggcaaccaactgggaataggctatctttaaaagtcacatctaactgagatcagaagtatatgaataagagccagctaggcataaagtggatatataaaactccaagcagagggaacagtgtatctgaaggttctaagtcaagagtaagcttgggccaggcacggtggctcatgcttgtaatcccaacactttgggaggccgaagtgggaggatcacttgagcccaggagtttgagaccagcctggaaaacatagagagatcccatctcgcaaaaaaaaaaaaaaaaaagaaaaagaaaaaactaacttaaaaatatatatatatcaatgccagtggtgtgtgcttgtagtcctggctaacttgggaggctgaagcaggaggatcgcttgagcccaggagtttgaggctgcagtgagctatgatcgcactgctgcactccagcctgggcgacagaaagaggccctgtctgaaaaataaaataaaaataaataaagaaataaaaagcttgatgagttctaggaactcaacattttctaacttcttattagaaatgccaaattctcaggcccaccttacacccactgaatcaaaagcactaagtgggactcagcagtctctgtgttaacaagccttccacatgacaatgagatgcacactattgtgtgagaatcactgccttagactgatgttttgagctatttaggggagggagagggcccattcagggacaatggtggttaacacatgtggctcagaccaagaaatgattgcaagcccaaaaacttgttaaatgtaaaacttcaggcgcagtggctcacgcctgtaatcccagcactttgggaggccgaggcgggtggatcatctgatgtcaggagttcaagaccagcctggccaacaaggtgaaacccagtctctagtaaaaatagaaaaattagccaggcatggtggtggtgtgcgcctgtaatcccagctacttgggaggttgaagcaggagaatcgcttgaacccacgaggcggaggttgcagtgagcccagatcgcaccattgcactccagccggggcgacaagagcaaaactctatctcaaaaaaaaagtaaaacttcatctgtctgaagtaacttctgaatttgaagataaacatcctcatggttgatattttaatggtttatggattattacttacttttaaggaagttaataggtttcattaactgccattttgcttcattttgtcacatataattaaaatttttcagacagaaaatattggtattttttctgtttccttagcaacctaaagcatgacctgcttaaatgacttatttgtgctcattaaaagcctttttgtgttaattgtgtatattttgtatttagcctctgtgaaacactcatgaactatctttttatttgttttaattgtgtcattggaaagcttgaagtattttgtggtttttttttttttttttttttttttgcttgttttttgtctataaaggggagataactggcagttgcagttaggattatagaaacattttcccaaggaaattaataaaatttgttcaagtttcttcttttacaaattgtacttatttttgattttttaaatagtggtaaaatacaaattacatgaagtttactatcttggctctatttaaatgtatacttccatggcattacatacatttacgttgttctgctgccatcaccaccatccatctccagaactcttctcatcttgcaaaactgaaactctatgtctattcaacgataatccccaccaggcatggtggctcacacctgtaatctcaacactttgggaggccaaggcaggcggatcacctgaggccaggagttcgagaccagcctggccaacatggtaaaaccccatctctactaaaaatacaaaaattagctgggcgtggtggtgcacacctgtaatcccagctacttgggaggctgaggcagcagaattgcttgaacctgggaggcggaggttgcagtgagctgagatcgagatcacaccactgcactccagcctgggcaacagagcgagactccatctcaaaaggaacaaaaaagaaaaaaccacagtaattccccattgcttcctgcccccagcccctggaaaccaccattctatttcctgtctataaatctgaatactcatttctatatcttctttggagaaatgtctattcaggttacttgctcattttttagtcaggtgatttgttttcttgctattgagttgtaggagttccttgtgtattttgaatactgaccccttaccgggtgtatggtttgcaaaatatcaattgctcctgctatgttcaacttgttcttaaaaataaaaacttttcctttgtggtcaatacttccctgttcctcatttccaaattttatacatgaaggaaatgtgagcacccagaaaagaaagaagatagacactgttaatatggccaagatataattcggcttttattataagaacattggagttacaagcttcatagaaagccatgtcctaaaagatgaagaattatgatcagtgcaaagagaaaatgttaaaaagaaaaagttatccttttatgtttgggtatatattctttttcgatattgtaaagagaaactagagttttttgttcttgtttttgagacagagttttgctcttgttgcccaggctggagtgcaatgttgcaatctcagctcactgcaacctccacctcccgggttcaagcaattctcctgcctcagcctccagagtggctgggattacaggtgtgcaccaccatgcccggctaatttttctgtttttagtagagacagggtttcactgtgttggccaggctcgtctgtaactcctgacctcaggtgatccacccacctcagcctcccaaagtgctaggattacaggcgtgagccaccgcacctggttgagattgttttttataaaaagatgtggattctttatggaaaacacagagcagttaattgctatttttttaatgtcacaaatttggaagcgtgttgagtctgagaagaaaccatagttaaaatataattactgataatcgcttgggaaataaaagccctaaatttcttcatgcctacaaacttaatattgttttcccaagatcttttttttgactttaacctttcttaagtgtttctgattatgctaaatctaggccattagttctgagtctgtttcattatttatattgttattcagtttactcgtcaaaagtgatcatgcccaaatatgaaagtttacaagaattgccctgaaaactgaacggaaggagacaacgaaaagaaactgcataatattttgccttcaggctatcacaataaaaactgttgctggaaaaaaatgcaatcacatcccttttttttttttaaagtacgtttcaatggcataatttattgtcgagaatgtctctaccagaagcataagtgatactaaaggcagagggttgtattcgctcagtctgcaaagtatcccctttgtcttagctccacacagtccctcagaatttggcagaaatgagggactcaactttcgagaaagggtgacaatcccagttttgttggagagctatgaaatagccccatagtgttagtaatgaaaattcacttaagaagtctcctgcaggcccggcacggtggctcaggcctgtaatcccagcactttgggaggcctacgtgggtggatcacctgaggtcaagagttcaagaccagcctggccaacatggtgaaaccccatctcttctaaaaatacaaaattagccaggcgtggtggcgggcacctgtaatcccagctactcaggaggctgaggcaggagaatcacttgaacccaggaggtagaagttgcagtgagccgagatcgtgccattgtactccagcctgggcagcaagagtgaaactccaccttggaaaaaaaaaaaaaaaaaggaaagaaaggaaggaaaggaaggaaggaaggaaggaaagaaaaaagagaaagaagtctcttgaaaaaaagaaaggaagaaagaaagaaagaaagaagtctcctgtataaaaaaaggaaagaaagaaaagaaggaaggaaggaagaaaagaaaagaaaagtctcctgaaaaaaaaaaaaaaacaaaatataagtgcttgacaactgaagttcaagggtaaaggctattgggaaagcagatgaagttaatctaagtaatggatgctgttggtgccccagtcagattcgttcactgggttggtgcacccattcctcagtgactctgagtattagctgctaaagcctcatggtttcacccctttccagagaacctccctcagccaaaaggaagccaccttgactggcatgtcccaccacaccttctctcttaaaaccaccaggggtacaaagggaaaacccctttgcctcatcatggcacctgctgttgtacaatttgtgatctgggaattcccatggggccagattgatgctggtctccagcccataccacatcccaacttaactttcttgccctgtcttcctgcttctctcactccctttttcttaagagcactcagactctgcttctcttaaacctggctgaaggcagtaggtatctgaaagaaaagctgtacctacattctgggcatcagagcagtcagggaaccaaccagaatgaaaagtcaaaaattacagataatgatggaagtctctgagcctgatacatttcatgaagggcttgcttacagctcaacttgtgtttctttttaattgtttcaacagcatttgagtagctcattccgcccaggtatttgagagattccagtaggcctctgatcctctggaaaaagcaagatacagtccttgactctcttggccccatgaggatgatatatctgctgagaaatgcaggagctgcaaaacatagctgggctgtacctgctgccaattcccgggtaattgcattctgtgagggcttccctgaaccacgaggaagagccccggaataagtactaaacaccagtatttataggacatgatttctaattgctcatccttgccttctcatgactagctcagcatgaagaatgctgggacttttctttcctagcacctcctctttttaggctgttttccaagagtcttggttaacaaacatttgtttgacaaggattcatggtagacagcaatgccattagtccctacttaagtaatatttgtaacataaatttctctgcacgtgtatgtagcccaagaataacacttcatttttggaacctagtaattttgaattcctagtaagtgagataggacgtctatgagttagcaggttaagattttaggaggaatatttaatatccctaagaagggaagtttttcaaacactgagtagcactatatatatttatatatatatagccagatttctatctatctatctatctatatatatatatatatatatatatatatatatatcacaccatttataaataaactcataagtggcaaatccagtagagctaatctgagcatcccagagtctcccctctctgtcgcttgtttgtgcagctactcctgctgtggccttttatggattatcctggacttctacaactgacccctctactttctctccatctacaagcttcattttgctttgctttcctcctaatccagtttagattccacagtatattttttcaattacatcctggctaatatcgaaactcccttatccctaaatgtgtgagccacagtcatctgacgaaaccccaaacctggatcaactgttttccccatgcttacatgcaacactgttggagaaaatgagaaagtcaggcagattggttctgctaaaaaatgttgaacctcatcctcaagtgggccctcaacactgtttgccaacctcattacatctcttaggtcaactccctctcacagtctctattacgattaattcaaatgttcccacttacccttaattcatgttttcattcagtgactattcattgcacaccaggcactgcacgctatgccaggcactgcagactatgccaggtctgttgattcctacttcacagaggaaataaaacccctccaagcagaattccctcaatttactctttctagtctttccaactgaccttctgtgctttgcagtaggaatgttctcttaactgtcaagtcaaaattcctccctcaaaaataagattcccttgttaatagacaattcctttattttcttagaaaagtagtagatgactataattttaaatgtgtatttgaacaaatccttagctacataaagataagcaaagatatgacaggcaatttaattttatatgaagaaaaacttattatatcagacttacctatcattctaaatcagtacttttgtatctataatcagacaacatttaatgaactgaaaattctgcctgtgagaaactagtcataataaaattagacttggtttgctctttcatggagaacatattccagatgtttaagtgattcaaagaaaacccacaatataatggctttcttcaatgttttctcacttactgcttccaaactagaaaaaaaacctaatgcaatcctgatatcacttaaatagcacctcgtattgctcagcgttaactgtgctttttgacattttaggtgtagtgtttaataatttaaacacaaatttatgtgtgtcatattaaaagctctaatctgtgaaatatagccaaaccaatgtcacatctatttaaatagcaaagtacctgtgttcaccctttacagggtgaaggtcttgtgactctgtgtttaggcggccatacttcttgttatgtatgctgctgggcactgagagcccacagtggtgagccatccttgggtggtaaaagctgctaccaaaacctaaatcaaatgccaaagtgaagactgacatgagcattctcctgcctccttttcctttttatctttcctaccatctgttatctcctttcttccaccttcatgcgttgagtgccctcatgatgatttctagctgactgaagtcctttagtctgctcaaccccatctagagacttccccaaagtgaacctttgcccccagttatctgtttatcaactgacctcacaccagtcaaagcttccattgtcaaatattttaacagaaatttaggaattcagattaaactgaatatttggcattttttcttttttttttttttttttttttggagacagagtcttgctgggtcacccaggctggagtgagtgcagtggtgccatcttggctcactgcaacctccacctcccaggttcaagcgcttctcatgcctcagccccctgagtagctggtactacaggcatgtgccaccacgcccgaataatttttgtatctttagtagagacagggtttcaccatgttggccagtctggtctcgaactgctgacctcaagtgatccacccatccacccacctcagcctcccaaagtgctgggattacagtcttgagccaccccacctggtctgggttgttttcttcatctttagcagttgtcttgttcacaactacttcaacaatatttattttctttttctttttgaagcaactctccagagtatttggcctggtttttatagaaataataacttttttcttttctttttaaactaatatttttatgatttaggaaatctttctttattaaattacataatcacaacagttactggcaaagataggtttgagaacatacacacaactgacggttgtaacaagtcaactgatgggagcagaaggtccacacatactgacaggcacctcgaacattttattgaggctgtgagaggttcccatcactgctgtttcacaaagagaatgaagactttggctaatttggtgagtcttaagtggagattagttcagagaacttccactatcattgcttgaaagaagcaaaaaaaaaaaaaaaaaaaaaaaaaatcccaagatcttatggtaaagtttaaagaagaaaagtaaattttaaaaagaaaaaaaaagaggaaaagggagagcattgcaattaattatgagtaccaaaacttatttttgaatccccttcatcctccaaaacattgaagcaggattaatatgtgtgctcaggaatttgggagagaaaatgaaaatcaaaatattctaataagagacatttgaaaatgtacattgtgtcacctaaagggaactgaaatctagctatggcttaacgaggtaggataatcaacttaatggcttgagagtcttgcttgtaaagagagatgattagcacaaaggactcacctgtatcactgaaagatgctgcctgctggcttgccctctctgcagaggttcctgtttacagtttcccctcacatgatatttatttgtggctactagaaatgcacgttattatccagaagagaatgatttcattttgtaaccgttgtccttgtccaagtttcccccattgacatttaagaaatctgttttctaacctttctattatgcaaaacaaaattaatatggatcatttccttttagagataagtattcatatatatggatttaaaccacctttctccatgggcccttattctgatacttttaatccatgtatttattcataaggaaatggaacaatatttactatccacccctataaaactttctgaatttcacactgattccagtgacattccactaacacgaagttgaatacagatgaatacatcacatatgattttttttttgcatgtgtatggtcagaaggggctctcttttgtttgtttttattaatatataattcacatactttaaaattcactctttcaaagtgtacaattcagtggtgtttagtatattcacaagattgtgccaccatcaccattgtttaataccagaacattttcgttatcgtccaaaagaaaccccctgattgcttaacgtaatgtttttaatgaccactttttaaaactttaagttcaacagagtgattatcacaatgttttgtattatctaagaactacacaacagtgttatgctctatacagcaccacggtttactgatgaagtattcaggttgatttgagaggataatgtcgttcttattttgaatgttcatactggctccttttatttggagtgggaggaaatgcaaggcttataaatgaggtcagtgtaaccaatggttttatcaacatagtgaaccagacagagaaataacacctgcccagatcaagcaagtcaaaacaacacgtatagtcaagtggtgctgtccttgtacacagacattacattacacaaactgttctcctaagtgagggaatttgtcccttagaaattgcttattggaacatttggacatcatgcatcatgttaaagatccataaatgccatctcgatagggtagatatgaggcgtggtaatatcctccccatatctgcatagggttcttctgctcaacggattgctatgatgtattgcatcagagactcctgctctagtgcttcaaagacagctgagaagccccacgggagccttctgaagtcattgctacaagggctaaaataccaggagatcaggaagtcattctgaggacttgacaaaataccctactccctaaatgaaactgttatgatgtggttggtgcaaagtatgcatgcaatattttatgactgaatatatctttctattgtaaaaaataaggatccatttctggttgtgacatgagtagaatttagaatccagcagcaatatatttttcttgttactttgccaatccagaatttcttaggggaagcatataacataatagttaagaatatatattctagaggcaggcaaacctgcatataggtatcccaggttcctcaatttttacccatgagagcttggcaaggtttgtttgttttgaaaacaaacctctgcaagtttgttttctcatgtataaaattagaattctccaactactggcctcataggattgttgggtagaaataaaatcagtttatgtatgaatagagctcatcatggcattaggcacctaggaagtgctcaacaaatagtagttatcattattcccccattaacaaatatccattgttataatactaccacaagagactgtcttagtctgttccagctgctataatagaaatgccataaattggatagcttgtgaaacaacaaaaacttatttctcactgttctggaggttgagaagtccaagatcaaaataccagcagatttggtgtctggggaaggcccattcctcatacaaagcaccttctcactgcaccctcacatgctgaaaggagctagctagctctctgaggtctcttttataagggcgctaatcccaaaaatcacctccctaaaggccccatctcctaataccattgccttaggtgttttgatttcgtttcctttttattttttaggatttcaacataggaatttgaggggggacacaaacattcaaaccgtagcatagagcaaacattactggcactgcaccctaaagagaataagcccaggtatcagttcttcttgttttaaatattctcatcttccaatttgcttttgactattgcacacaggcacttcgaggagaaattgcgcctctgaaagagaacgtgagccacgtcaatgaccttgctcgccagcttaccactttgggcattcagctctcaccgtataacctcagcactctggaagacctgaacaccagatggaagcttctgcaggtaagcacattgtaaacattgttgtcctttgttacagtaaaataatatacagataaaatttgtaaagaacaatgaaagtacttttttcatgtaatgttcatggtaatatttgtgaggataggatattttatattagtttataattcccatctaaacattttcaaattattaatattaattttggaagcaactaagacttagtatatgtcttagtctgtttagtgttgctataaaagaatacttggggctgggtaattcataaagaacaggtgtttatttggctcagttctgcaggctgtacaagaagcatctgcttctggcgagggcgtcaggctgcttccactcatggcagaaggcaaaggggagctggtgtacaaagatcacacggcaagagaggaggagaaaaagagggaggggaggtgccagttctcatgaaaactgctagagcaaaacctcgctcactaccgtgagaatggcaccaaaccattcatgagggattcactcctacaacccagacaccttccactaggcctcaccaccaacacgggggatcagatttcaacacgcgagttagagggaacatccaaactctgtgtagcagtattcttacgataaacagaaaataatgctgaatcatgatggaagatgtgaattgccaccatgcagttcctttgtactcttactgcttggattctcaaaaacatctttccctttagaatcctaatttaaacaagagtcaatagtaagatgtgtccaaaagtcatttaaagaaagagcatcctatcacaaacttacatgtggaagtttttcgtaggtttgcgtaataaatacaggcaatgtaagtgtgctgctcaaggtcacacttactagccatgggacctggagcaaattacttaacctttctgagcctcagtctttcatcaaaaaaaaaaaaatgcgataataaaattctctgcaatatcagtttattattaggatgaataagtcaaaataaatggaaagtgctcgggagcgaacatgccaaatgataaacactctacaaattctagctcttgatgttgttattattattattattacagtacacaggttttggaatccaacatattagctgagtgaccttgaggccacttaatctctgtggttgtccatttactcatctctaacatggttactgtaacatcgaatgagttaattcatgcagagtaatggttgtagtggtggaagaggtgcgtctaccttctcagtgtgaaggacaccatgttataccccaaaaccctaaaattagtttaaccgtagaattagagaatcattttctctcctttccaattttctcctttccaacaggatgcagaaggtatgcctctgaggaaactgggtttaaaactatttggttttaactttttaataagaaaaatataataaaccaaatcactttcctattgtcagtccatttaggggtgtgattgagaggcctgttaaagaattgctagatctttaataaagataagttgcaaatcccagacctcttgagatctcacataatttaattcttgttgtgatggatagtcctgaaagatttgtattctagattgttataagtggcatcgactaaagcaaggcgatatagctaagtgattatatgcctttctctgtttgctccatagtagttgagtactattaaaattttatctgttccatccttagtatgtttttcatcttaagtataaataaggaaagtaataaatgtccaaagaaaaccaatggccacattagtcccatataagtgttctagaagtatattttataatttcttttagagagcagaatgccacgtttgctttcagaacgtggtaaaagatttgtgacagtggcaggtagatttccaaatgaggtcaaaggattatgactagtaagaaaagtttttttttttttaatcaatgctaagtgatccattctagttgcactatttatttgcatttaaggtatcaaaaacagtaaatagcttactatgtagccattctttacaatgagtaaaaacttggttataagtacaggaaaacacatgtaaggagatagtatgatatagcgaaaagagcattggattgactattaggaggtctaacttcaaacttaagctcagccattatttgaccgtgttattgtgagaaagccatttaacctctctcagctttaattctcctcatttttaaaatgcagaaatctattttgtctaaggtcacatacagttcaatcttatgattctgtctctagatatctgggggagatacacatttgacagaatttagtttaaaaccaatgaagttcctttctttattcataatacaaatgtggtttgttgaaattatatttctccttgtataactctaacttttaatctcttcttccctaaacccacatatacacagccttctcctattaaacagttcagtttgtggtgtctgctctatattgtagcaaatttcatgtttctatttttgaacatgaccttaaagatatgcttaaaaagtgtttttagcagaaagctgataaatccaaggttttggtttgcatataaccgagtcaagttagttccattcttttctttgatagtaattctgctacattataaatgtgaggccttgttcagaaagagaagaaagcaagaaatgaggttcacatcaagcaatttttttcccattactggaaaagcaattcatacatcctgttgagaatattttatatttagaacaatgtatgtgaggctaacgcattatccaagttctatggcgggaagcttgagcccaccaccattatgacatcatatttttttaaatagtaaatgtcaaaaaagacatatttctatgaaaataaagaatttagtcacaatgctatgtcaatctttaaatcgtgataaaaaccaagtacaagttcatctttgcctctgtccactaagacaaagaacaatcaaaaagtaaagaactctctgggcatggtggctcacgcctgtaatcccagcactttgggaggccgaggcaggcggatcacttgaggtcaggagtttgacaccagcctgaccagcatggtgaaacctcatctctactaaaaatacaaaacttacctgggtgtggtggtgcgtgcctgtaatcctagctactctggaggctgaggcaggagaattgcttgaaaccaggaggcagaggttgcagtgagctgagatcgtgccactgcactccagcctgggcgacagagccagactcggtctcaaaaataaaataaaataaaataaaaatagagaactggagtagtagaaaggcagatgtaaacctgagaaaagaagaagagtcttaaatttgggcaaaatagtataatagaaagattagagttacatactatcaggccgtgtctacttgatatcagaatatcctgggttctttgcattatccattcatttaattttcaaggaaagccatgctagttttttagctgtctgtaatatcagtcaaaatggtgaaaccagttaagggatgtgagcaccaacaatacagtcaaacccagtcacaatttacctatgtatagaatcataatgtatagagaattccaaactgactttgaatcttctaatagaaatgtaagagacattggtttgcctgtttgaaattttctgtgggaatgaagtcctattttcttcctcaaagtagacacattggtatgcatgttactatttgaccatttgactttttgtggtgtaggaaaccatcactccttgcagttagaaaaagtcctcatgtgcattctctcatctaagaatcacaaccttgtgattttgtattatgattatgattacctattatcattattcccttttacgtgtaaggaaaccgaggcttagaaacatgaagtaccacagtcacagtcacataacttgtatcagtcaagatctgagtcaggtttttcgaactgctattcccatgctctttttgtctcctcttctcaaaatcctattacgtttggacttaacaaagcaataatggctgggtgtggtggctcacgcctgtaatcccagtactttgggagggtgaggcgggtggatcacttgagatcaggagttcaagaccggcctggccaacacatagtgaaaccccatcactactaaaaatacaaaaattagctgggtgtggtggcgcacgcttgtagatcagctacttgggaagctgaggcaggagaatcgcttgaacccgggaggcggatgttgcagtaagctgagatcatgccactgcactccagcctgggcaacagagcaagacaccatttccaaaaaaaaaaaaaaaaagcaatactttaaaactattttggacaatacaggtgtaaaatacttcacttttttacatgtatcttcttttttgaaatgattcttaggtatattaacttttaaatcttccttttataaaccaatggattaatgaacccagttcagtgtaccccttagaaatcacacttgtttcaaatataaaattttaaagcattatattcctcattgcctttagaactcagcaattgtactaaaatcagccaaaagtgatttcagtgaatcagctcttaaagccaaactaatgctaatatttgaccaagtagaaacgaatatctaaaccaggtgagaaaaaagttaaaatgatgataaacctttctaattttgaaatagtacacacactgagtaatgcagtcaatctctttattcaccaagcgcaagtagtatataaaggaatattataccatttttctttactcatgagtaaacccacaaatagcacaaaagctgcaaaaacactttaacataaggagtatttgttttattgactgtaggaactcatggaatgcaaacacctttaaaatctgaataatatgaaggcatttccagctattagattctttacatatgtcaaagaacagtatcataaattatgtatgttttttaaaggtttcctaagcttcttccaaagtcatgtagacatcattacactccatctgtatacctctgtggtaacttgctgtcgcagggatctagagcctcatcttttgcaaacttcattccttctttcatccctttgttctttcattcagtcagcactgattgagcatctactgtgtacctagaagacattgtaatgatcctgtttggtccaaggacatactaaacaaaactccctttactgcttatgctatattaagtaaagctttaaagatgggttctcttttattacttccatgatggcccacccctctcatcctttctcagtgttaaaaaccagaaatatacatacttacatactatcataacactgatactacaaaagcagtacccattattatctctggtttacaaattattcaataatttcttactggaaacttggtctatatagtcatagtagtaagctttgtgagaggatgtgatgggatcatagttagctaaacaataggagtatttgtgtggcttcattttaaaaaaactaaccagtttttttccaacaagcaattcttatatcagaaccatttatattctttactttggtgagataggattttctaagcaggtcttttatctgtatctatgtatgtttgttcttaccatcattgagcacaggatttgatcctttaaatgtgttgacagattttgaacattttcctcatatctttcttttttgttttttaatgatcctgtactaatcattttgcattatggggtcacttctggacagagagcctagccatctgctcttacaaataatgtcggcctatcactaactggggataaggagaagacatctaccgatgtctttctagcatgtccttcttgactttttctttctttaagaagactaaaatgattcagcttgtggttctaccacagaactcaggagaaaatgataaatatgaggccattctccaaataaatatgttttcctacattagtggttctcaaattttaacaagcatcaaattcacctggaaggcttattaaaacacagataactgggctccacataccaagtttcaaatgattcagtgggtctggtgtggagcttgagaatctgcatctctaacaaactttcaagtgaggctaatgctgctgaatcatggaccacactttgataacccctgttctatgttaagtacttgtcaggtacagacaaatttaaaagttaaaaaaatatatatatgacttctgtaagacactgtgaagggtttagactctggggaaattaagtataatgccatcccaaaaactctgtgttggaggagtgttcaagtgctgcaggatcatggagaaccaagcacttaacttttctatgaggcagaaagaggaagataaagggaaacgtggaggatgaagggaaactgttaatagatccccagaaacacaatttgctgctatatggatttatatttactgtatttcaaatcacatggtctagaactgtgctgtccaatatgatagctacatatggccattgagcccttcaatgtagccagtcgaaagtgagatgtgtagtaagcgtaatatatacacatgtaatatgtatatgttatatatatgatatagatgtaatatgtatgttatatatatgatatatatgtaatatgtatatgttatatatatatatatatatcaggatgcaaagacttagtaccaaaaaaagaatgtaaaatatctcattatttttatattgattacatgttgaaatgatagtatttttatgtatttgcttgggtaaaatgtcataatgaatttcactcatttattatgattattcaaacttggttatttttcttgaaaatgaatgaagtgagcctgttgcttcggctacaacaatgggcagtgtttctgcaaaatttttacatgtgcctactagaacatttaaaattgtacatgtagcactcattatatttctgttggatagcattggcctaaaagttttcaaaatctagcatggataagaatcacctgcaaagcttgttaaaccaatccgcccccagaaatttagtatcgggtgaggcctgcaattctgcatttctatcatgctcccaggagatgctgtctatttgtaaccacatatagaaattcattcccaaactacagatgatagagttttacagagaggtgcaaaaatatatttttgcatcaagcattgtctgtagcttgaatacaaaattatgttgcccatataccactggtttttgtaagtaaagcagttgtgttacaaagcatacaagtttttatcagctaatagccttttctcaattagcagatactaagtagtacttttattatgtggcaattctccagtttttggaatgttattgagaaatacacagggttaaaacaaattagaaagcacctctcccaaaatactgcagtaagatgtaggaaaaactgctctaacatattctaaactataggttgctcttatgtaaatatttcaactataatatctagtctgatgtgcccactggccagagttttgtaaaagctaaaagtaaaggaaataaaaaaaagaaagaagtatgtgtttgtttttgaaaaggttaggtcacagaaggatttgttgatattaggaatagaatgacccgtgaaaaaaggacaattaagttccaggaaaacatcttttcagtaaggagagaataatcatttatgcttaacctcaactctgttaggaaaaaaaggatgtaaacaaaaccctttaaagaattgaagaaggagagtataaatttaaatgcccaggttagtgaccacccttagagcatactgaggtcaaagcgtactgtcaagcttaagaacatttggttttcaatgtttgtacaactaattgtactttagtcaagaggactgttatcgaaattgctcaggtagccttgaaactaatatggcccaaatattccagagtctgtctttctcaccctaggagaagaatggtctggttttcaagggaattctctattttttttttttgaaggcatcaggatgtgtgaaactacagggggataaatgaacgatgtacagaatgtgatgaaaaaattatatgaagtataaaatgggaatgaagccatcaggagccaaagaaatatttatgaatttaagagaatgaaaagcatattattattttcagatattttataaagtgaacccaaatcattataaagtattaattaggctacttgattgcttgatctttatatactaatttctaatttgttttaatcgggaactatttttgctagttctaaggctagctattatggtaatccatgtaagtgtgtttattattgtttttaaaaatggaatgtgttcctagtaaatgtgtttaaatagcaaaatgtatttatgcatgcatgtatttattttagtttcctgagacctctagttccttactagaaacatgtatataattccaggcatttaaaattgccatgatggtcatgttttcttgtccttttcccttattctgcaactgacatttgcccttgtctccaatttctcactgctttattctttgttcttgtaagtgttcttgtctctctgggctgacctctctccttccctggagtttgaccccgccccaccctttcttctgcatttgtttgcactggttgttttcttcattgcctttcccactgccccgctgcgctgcatgtgaaacactccgccagtagctgctcacagttcccatgctacatcatacccagcattcaaagagctgctgttctcacatggccgccagtaagattcccgactcctccttcacagcacattcctctagaaagtagaaagaatcccctttcaggccacatgagaagctgcgtgttaaagccaactccataaaggggaatggaaactagcgtatgaaattcagaaatgctacttttaaaggtaaataccacaaagtgaatttcaaattcatacagtttatcataatacttctttatttttataaatgctataatgtccttaatataatgatcactgtgatataagttgtcctctcccttaatatattaattaatttactaaaggagacgggagggtggaaatataataaattagaagatgattcttatatcagaagtacagcctttatacatagttttactttattcagacaatcaatgtagtcatatggtataaatttgaaaataattttagtgagcattacgcttactgagattaatagtgagaacttacctagcacttactgtatgccattcacaattataagcacttttgcatgtgctaatgcttttaagcctcacgtaacccagtgagggaggtacaattttaacctcattttacaggttagaaaaatgaggagcccaagggttaagtgacttgcctgtggtcatatatcaggtaagtgagagagccaggatttgaacccagacagtctgcctggggaatctgtcagaactcctaactatgcagtaccactcctctgataaaaagttgaattgacatgacaacatttcctattcatttatgattcgaccctttaaacaaaaagaacagcatcattctcacatttattaatttgtcaggaatcacctggatcatgagttgaggaaatttaaagtaggagggttgtatgaatttcagaccacgatctcaagaattgcctgtttaactcagagcctgaatcattcacagactaaaaactagaatcactcttctgtaggaccaagagggttgaatcatcaaagtcttgctgaagtgaacggaaatcctcctttgttcaatcattcattcaataattatttttttctggtgtctactctttaccaaactctgtttgagatgatagggattcagtcatagacagaccttctctgccctcatggaggttatggtttcttgggatgacagacagtaattttttaaatctcataaaataattacaaatgtgtcaggaaagaaaatacaggacactaccagaatatatagtaaggacctaaatgtgtgtgtgtgtgtgtgtgtgtgtgtgtgtgtgtgtgtgtgtgtgtgtgtgtgtgcgcgcgcgctgcagtaagggtgagaggcaggaaagggcaatcaggacaccctcccaataaaagtgacctttgaccgagatctgaaggatgaagacaagctgagtgactcttctattcatctatatcttttgttttaaatggcctgaagcctgggactaactaaacagggttgtaaaattccagtatgtaaattgaataactagggatcatttgaagtaatggactgcagagttaatgtataattaagtcacatctagggaagatttcccatcattatcacagagagcatcctgtttgctttcttcacagcacttacgaaaatctatagctatgtgtttggtggcttgtttaatgaaagtctgtttcccctatctgaatgtgagctccataaggacagaggccctgaataccacatctactgacatttggcagtgtctttcatatagtaagcattctataaatgtcttgaatagatgaatgcataaaactaagttaaaatgttactgaaaactataaaaataagcagaaagttataccagaggagaaaaattaggggaaaaaaactataatttctgaagacgtagtacttacatctaaatttgtggcttcataaggttaaccaacacttaaatagttttgccaaaactccaagaaaaaaatgaccgggtgtcgtggctcacgcctgtgatcccagcactttgggaggtcgaggtgggtggatcacctgaggttaggagttcgagaccagcctggccaacatggtgaaaccctatctctactaaaaatacaaaaaaattagccgggcatggtggcagacacctgtaatcccagttactcggaaggctgaggcaggagaaccacttgaacataggaggcggaggttgcagtgagccgagatcatgccactgcactccagcctgggcaacagagcaagactctgtctcaaaaaaaaaaaaaagaaagaaagaaaaaaaagaactaccatttgacccagcacttccattacttggtatgtacccaaagaaatataaatttttctaccaaaaagacgtgcgctcatatgttcattgcagcactattcacaatagcaaagacataaagtcaacctaggtgcccatcaatggtggattggataaagaaaacgtggcatatatgcaccatggaatactacacagctatgaaaaagaaggaaatcatgtcctctgtagcaacatggttggaactggaggtcattatcctaagcgaattaaagcagaaacagaaaaccaaataatgcatgtgctcacttataagcaggagctaacctttgggtacacatggatgtaaagttgggaacaacaggcactagtgacaagggcaggagggtgtgggacaagggctgaaaaaactacctatcgagtactatactcactacctgggtgacaggttcaactgtactccaaacctcagtgtcacacaatatacccatgtaataaacctgcacatgtaccccttgagtctaaaataaaaattgaaatctaaaaatataaaatatcaaatcataaaaataaataagaaaacaattgaatctactgatatgtttcattgcttttaaaatatccactttgaattactgaatattttaatatttttagttttacacttcagcacagaaagtccagaaatccaacccttgagtttacaaagacaccacatgatagttcatagttcacacagctagttagttgtggaactagaacccaaaatttgctctctatgtctctcacataccttttccctttattctaataaaggcatttgtcagtctaaatgtacaatattcgaagacattttttaaaggaactacttatccaaatcccacctgtcttacaaggtccatgtgaagcaatgagataaggtctgtgaaactgcttccgaaactatcaaatgttataaaaatgttaagttttattattagaactgcagttcatctctatgaaacctttctaaactttctcacttttctgaacttgactacgcagcgtcttttctaatctatttgttctccctttataagaagaatttaatcctttccgccctgctgggttgtaagaaaaaggactctcttcttttctataatctattgatatttgattatattacacatctaatgggttcccaataaatacatagtgaatagaattgaaccaaatttctttctagacatgtgaaaaaaaatcctgatctttaaatagaaagggtactttcaaagattatatatagaacctcttggtattttgtatttgcaatgaaaatattttaatttgggccaggtgcggtggctcacacctgtggtcccagcactctgggaggccgaggtgagcagatcatgaggtcaggcgttcgagaccagcctgaccaacatggtaaaaccccgtctcaatcaaaaatacaaaaattagccaggcatggtgacgcatgcctgtaatcccaactactcaggaggctgaggcaggagaatcacttgaacccgggaggtggaggttgcagtgagctgagatcatgccactgcactccagcctgggtagagagggagactccatctaaaaaagaaagaaagagagagagagaaagaaaagaaaagaaagaaaatattttaatttgtcttatgttcaacagttgcatcatatctgcatccttttgttaaaattgaacaggcttctagtttcatataataatttctggccaggcgcagtggctcacgcctgtaatcccagcactttgggaggccgaggcgggtggatcacctgaggtccggagttcgagaccagcctgaccaacatggagaaaccccatctctactaaaaatacaaaattagctgggcgtggtggcacatgcctgtaatctcagctactcgggaggctgaggcaggagaatggcttgaacccaggaggcggaggttgctgtgagccaagatcacgccattgcactccagccggggcaacaagagcgaaactccgtctcaaaataataataatcataatcatcatcatcataataataatttctaccaacagctggcaggaaaaaaatatgagagcatagtcatgaacttcagattccactccccttacttttggcattccattcctctgaattatagcttatatttctttattatctcagtttgatttagtctttctaaatattcacctctgtttccatccataaatatcgactgaactaccttttaatatactatctttttgtaacagagaaaatcaagtgtaggtggattattgtaagtgacactgaggaaatataaaaagaccttgacttgtccaggcgcggtggctcacgcctgtaatcccaccactttgggaggccgaggcgggtgaattacgagatcaggagatcaagaccatcctgaccaaatggtgaaatcctgtctctactgaaatacaaaacattagccgggcatggtggcaggcgcctgtagtcccagctacttgggaggctgaggctggagaatggcatgaacctgggaggcggagcttgcagtgagctgagatcatgccactgcactccagactggtgacagagtgagactccctctcaaaaaaaaaaaaaaaaaaaaaaaaaaaagaccttaacttgcttcaaacaagtcaggacccccaattccaattcttaggtctggcattcccatcagacacttaaactgtaggggcagtaaagttgcccatgtggctacagcttttgtggctgtgctgtacttgggaattttaatgttaccctctttgaattaggtccttcattgatcatgcatctcaaagtatctcagtgccacataaaaattttctttcagagtcatattttcccattatgaatgctacctactgcttatctgttgagtgtacacttttaaaccttctgtgggtggtggcccctttgccactgggtgagttagatgctgatcctggtcattatcgctgcctttccagccttttctgctcttacaccaagcacaagaattctctgctgatagtcaggatctagggctgggaaaatgggatgagttgtcctgttagacaggcccaaaaggagtattgtttaatccccagggtgtggggaagaaagatactcttgttttcttttccccaaatgtgtccatatacacccttctcctttgctggcagccaccaggcttgttgaggatctaccctcctctgcatatcatgtgcatcaagggaagccccaacccaagggaatacataatgatagtcctgagctatttcatggtgctctcgcagtcttgattgccctcttcggaattggacatggtcatattacgcaattttaggtaataaaatacaaagggcattcagctaagggaccttctgagaaaggtttttctcgtctagagaactaaacaggcatccttctccgggcactatgcgtagttctttattctacctggaacattctttctccagaaatctttgtgactaactctgtcatttccttcaagtcttattcaaatctcaacttaaaaaaaaaaaaaaccttcttaaaatttgaccacactaattagacagcaactgccccatctccctcttcccagccatctgaatccatttcccacttacctttttatgatagctcttctaggaaggcactccctcctccctgtgaatcatgtctccaggcaattgttccttgtgtagaggaacacaccaaatctgggctgctcctgtacaacaaactgaaggaggtagaattgattctgcaagaagttcaaagctaaataagaaggagtcttgtagcttctgtcttggtcttctggaatgctcactctggggaaagtgatctgccctgtactaagtctactctaaggccactgtgctgtctacatgaagaagccacaaatctaagctagccacatggggaagctgcatggaaagacaaatacgtggctagcccccagctgttggccgaagatccgcagccatcccaagtgaggagccagatgtacaagtgaaaaaactgtaacagccattccaatggagccttcagatcaattcagctttggctactatctgactgcaaacacatgaaagaacccaagcaagaaacacccacctgagcacagtcaactcacagaaccatgagcaatactgataaatggttatttttagccagtaagttctagggtgatatatagcaaaaggaacatctgtcctgttttttctggtttttcctatcatacactcattctgcaggattaacatgtgtaatatactttttttttttttttgagatggagtctcaatctgtcgcccaggctggagtgcagtggcatgatctcagctcactgcaacctccgcctgctgggttcaagtaattctcctgcctcagcctcccgagtagctgggactacaggcatccaccaccacgcccagctagtttttttttatttttagtagagacggggtttcaccatgctggccaggctggtctcgaactcctgacctcgtgatctgcccgccttggcctcccaagtgctgggattacaggcatgagccaccactcccggcctaatatacttttttaaattgtctttcactatgagaaggtgagctccatgaggccagggatattgtctgttttgttagctaatgtatccaaattacctaagaatagatcttagcgtggtaaatatttgttgaatgaacgagtgaatagatcagaatttcagtagctacgttgtgagtatgtggacagttcaccaagaatggcagaatggaaggatgggaggaacctggaataatgtcattgtgcttctggattacccagtcctggagcagctttgcctctgtgggccttgactagtcaagacattttgtgttgggtttttatgttaattccatttgcatcactataaaggaatacctgaggctgggtaatttataaggaaaagagatttcattggctcatggttctgcaggctgtacaggaagtgtggtgacagcctctgcttctggtgagggcttcagcaagcttacaatcatggtggaaggtgaaaggagaaccagcgtgtcacatggtgagagatggagtgagggggtgggaggtgccacactcttttaaacagtcagatcccacatgaactcactctgagtgagaactcacttattactgcaagaatggcactgagccattcgtgagggatccagccccatgatccagtctcccccaccgggccccacatccaacactggggattacatttcagcatgagatttgaagggaacaaacatccaacccatatcagttttctacaacctgcagcagaaagcatctcatctggcacatggtcttgcaaataattctgacttagatgcatgggactcagatatgactgaaccagaagataaatctaagtagcagacaccacagtattctcaaaaccactctttctctttctcttgttgaccgaggcttttctactgagcaaagcacctggtttataatatgttctttcattacgccttctcctaagagacctccttagtgtccctgcaatggatgtctggggagccaccaatctcttagagatgactagacatgtagccccagaaatggttacaccttgagcttttctctcagtgcagatgagatacattgcccatcccaccaatttgccacatttatctaaatttctgtgttaagctgggacctctaccactcaagctgggatgcccctcaccaccaccacactgcaaaaactaaacatttttcattagcctcctacttgcaattaagtacataaaacctgcaaaacaagtaataaaattaaggcactatttggttaatgccttttctcagaaatcacttttgcatgaagttcagttcagtattttatcagtgactacattagtctcgagaccctctacccaataggagggacaaagatgtacatgacacaggctcccttcaaagatgattaatacatgaactacatacagtattacaagggctccactagagatgtgagccccccagaaatgatattaatgtgcagaagagttagcaataaattttgcacaaggggtgacatttgagcttagactcgagcaatgagtagggttccaagaggtaaagaaaaaaatggaatggttttctaggaagaaaaccaggtctgggaagatctgatataacctgaggtagtttataagtctggaatgactgagttatcgggtatatggtggggaaggcagcagaggtgaaataagtaatatctaagcaaatgaaaaacatgtaattaggggagatgaaatataattaaattatttaccttaattcctcttttgactctttacatttgtcattcataaggaaacaatttcactaagattgttttgacctttttaccttatttggccaagtaaacaagggacagaaagtttttaatgtaaaatattcattcaacctgaaagaacattgatgattccagaccatttaaagttaaatattttagagttctcaattatttctatttggatgagtagaaccttttttcagacttcaggaatatatgtttagtttttaacagactaattgttcctgctttcatgccagcctcatgggcatcagcaggttcaaggttagtaggtaggaatctgccccctaagaatgcagcctaagagttaaggaatgcatgattacccctgtaattacttgagaggggctctgaaattctggcagggttggtgaggccaccagataacactgatcaagaatgtacacgaggttaggaattcagactgtagctgaagtggggagttcgggtaaacaggctctgaatggaaaagatcaggaattcaaatagacagttaagtcaagaaaccaacatcttagaaatgtaaacctcactttaagtcaaaggctctccaagctaagacttcataatatatttgccaaggcaagagctagtatctgcttacctgagtggtcctggagctgcggccagttgaaacaggagattgcagatggaatgtcagttagaatactttcagaggccagtaacagatacctgactttaaagttcttaagtttgtctttcccaaggttttctggtcataagaatcaccaggggcacttgattaaattattaattcacaagccccttcactggagattctgatgcaatagacttgggaatatatttttttttaacacgaactccagtggaatcaggcaagaagtgaaaaccctatcgttaataatagacacattagaaataatagagacatttgataatctagcacagttcccaaactttagtatgcatcagaatcccctgggggcttgttaaactacaggctggcaggctgctcccagcgtttctgatgcagtaggtccagcgtggagtccgagattctacatttctagtaggttgccaagttatgctgctactcctgtggtcaggaactgcactttgagaaccactaatcaaaataaactgaagtccaaagaccatcagacctagagctggttaattcaacagattagctatatcaagacttgaggtcagcttctctgggattctcttgtctttttcctcatggtcccaagatggcttcccactgcgccaagcaacatatccgcagacaacaataaccaaggcaagaaggaataaggttcaaggataactgtattgtgtgcgtgtgtgtgtgtgtgtactcatgcctgtgtgtctgtgtttggaaaagcaaacgtttcccagaagctccccaacaaatttcttcttatgtgtcaactagaactggatctcactgaacctctttaagccaatcactggctatgagaaacaagcttactgtgattggcttagaccagattttaattttttcctcagagctgtgtcctttgttgcccaatatctgaacataattgagcttctttaccaaggaacaagaagtaaatagctgttagttaggcaaatagctgggtatgtccacaaatgggttctgaaacaagtgtgattataatgaggttcagaattgaaaatattagtacaaatgctagtaaataatgtatgatattggctttcttatcaccatttgcaacagaataacagtctcatgaagaatttggcacagccattgtagaaaaagtgccttttcagagctcacagtatgcatgtactcatcttgcttttattatacctgtatatggaattgcaagctgtcccttcaggtaatgaaatttagacaagttggaacctgtataacagcaaatcaatactgaaattataggcaaagcctgtacttgtgcagactaacacataggatagaaagactttgtgatcaaaattcaacaaatcccacatttataggtatccaacatagagagaaaactatatatagtggtgtgtctttttatgtgtttgcgtttttctccttattcattcctgaaagtgtattttcttttaacagactcacaactcagctacaccccatatgcccacagtcaacacagtggaaaactgagttgtttatttgagcctcaagtcatccaaatacttcgttaaacgttgtagtaaaaggtctcccctgaattcaaggaggatgccctaagttttctgcatccttttgatagaggaaagtattaactaatgtcagactatctgttgttttattttcctttacagcactagattttgttaaggacattgataattttgaaagagaagctaagctaaggtgacaaatatatcttctgttggtcaatatctaaaattatgtattatttcttttttgactacaccttacagtggttagtttgcactttacgtaaaaaactgatgtctaccatcttccatctttgtaagcaccatccagcctaatagttgttggtttgaataatgccacaagctttgtccagaaaccaaaaacctgatttccaaagactagtctatgtagctgagcccttcattccataatcattaaactatggttaggacacagtatccagtctcccctcaaccttgtccaatcacagtctatgcagagatcatgtaactcgattaaaatctagaaccatagagacatttcccttccctggggcaaatgggaattgcacatgggggaaaatggtgtggataagcaaaaaacggaagtttccaaagtgcaacagaatattgataattttagtacatttcaacatacagtgagtgtaatgacggcattttcctactgcttccttagttgtgaagattttgttttttcttctgggttcactgccgggaaaagagcagaaaatgttttagagcctctgccagcagagggggcatttaccatttgtgcataaggtctctggcactgtgccctggggttctcttttctatatgtttctaacagtcacacacagcagtgtgactgtttacagatactttaccgtcttctctgattgaagcagggactggtttgccagcaacttttggttgtttttgtttttttgaagaccatgcaactaacagatgtttgttgttggctccatatctacattctttgaaagctggagaatcaaattgctgacattcagacaacactaattcccatatccagggagcctaatttgccgtccctgagatcctgattcctggtgttcacgggtttaaaaaccatttcagtgacacaatataagaatgggcttgggagatgcagcgctgtctccactaaagataatcacattttataaacatctgcgtcattactggtatgattcatctctaagctgtatacagctgtgtttccagtttcaattaacaatcccttaattgcatatccatctcatgttactaatttagttaatttattcataattaagagtattctgttttctaccaaggtttgtcgagctcagaacattataaagaaaaatattttaaggcagcatctccgagggattttgtttcttataatcacatcacagtaaaatgtcattcatgcgcccaaaggaagatgaattgctaagggatttttttttccagtaaaataagaagctttgggaagctgcagtgtgttgtgtttttaaaccaagttaaatgcgatgcattttgttcttttctttctccttccctgacatcctctcaaaaaaattatcattttatttgtattattgcttaagtatcacagcaaatccagtcaccagtgcaaataaaactgtcattaccctgtcaggtaatggtgtctcttaaaatctaagctataaagtctgtacattttagaggacattaagatcaagaatttttaaattgcctaagtctaagcaagtggagtacacccttgtggaaaatggaaggcagatgaaaacatgatgccaggcagtgaattcattttagtttgatcttttctacaaaaatacatatatccgtgcagcaagagtcttgcctgtgttagtacatgtgtctgtgtgtcattcaaagcagcaataacaaaaaattaagaccatttctcactttgtttattgttcaagaactcccacctatagccttgacctgtgtttgagcttaaaaaaaaaaaaagtcttataactgcccagtggtttggagattttacacaatagaaataataagccatcttttgcctcacatgaattctactaaaatcaaaactccataggatactttccaaagtaactggtgaaaggaaaagtgtggtagtataggtatgcatattatccccatcactttatttctgagctcttctattttttaaaaattttaatttgtatcttaaaagggcaaaacataagaagaggtaggagtattctaaatttcagtgacaacaaattcatttattttacaatttaaccattgcccgtcaacatttacttaaaatttcagcatgggaggttttaaacacttctagagtcccatcttaccccatttccacgatgcttttcttctccatgtgttgctgcagtttaatattgtctgcgtgttttaatatgttaaacgagttaaacatagagtaggaagttaaaactgttagcagctatatgtttcccaagattgatgaaaattcaggtaacactccaacctgttaaagatacctgcaatctggccaggtgcggtggcccatgcctataatcccagcactttgagaggccaaggcaggcagatcacctgaggccaggagttcgagaccagcttggccaacatggtgaaaccccgtctctactaaaaatacaaaaaacatttagccgggtgtggtggcatgcacccatagtcccagctactcgggaggctgaggtgggagaattgcttgaacccggagcctgggtgacagagtaagactctgtctcaaaaagaaaaagaaaaaaaaaaatatatatatatatatgtgtgtgtgtttatatatatatatatgtgtgtgtatatatacatatatatatgtgtatatatatatgtgtatatatatatatatatgtgtgtgtgtatatatatatatatatatgtgtgtgtgtgtgtatatatatatatagaaagagagagagagagagagagagagagtaagcagggaggggttgaagccagaaaagactagaaattatctaggccaaaccctttaatttatagattaggaaatagtttctggttgacttagctgagacgttctcatttgttaaaagcaagatcagaaatcagacacaattcaacgctcttcactacaccttgtttttctctttgtggaaaacaagacgtatcctgttcaaaaatttatgctgtttatctgaaagcccaaaatgcctgtttacatcatattttccattttgcaatagcagctcattttggggattattttctgatgaaatctctaggtttagttgtacttgaatatctttttatctgtacacactggaatatgcatataataattgatagaaatgtggattttaaaagtagagatgatcattattattttatgatcctttaagttaataaaattcacctagaataaaataaacaagtttaactaaagttctcgcattttcccagaaatcgtagactagaaactagtcttatttgcttattttattccaaagcttattttacctctattattttgtggttctataaaatatttctgtgtattcctccaaagaacctcttggaaaagaaagtaaacatcacatctgaaaaatagctgggcattttttcattatctctgcaaggggaggggacgtgaaaggcaaccccatatagaaactcaactccctgctttttacaatgaatgaagtttttccactgcactgtcagaatggtaattcttgctaactactcacctatttcacaacattaacagagttccaggattcatgctttaatattgcataatggtccatgttttgaacatgaggagtggcagcggagattacactttgattccttggatttcatgtggcactggatgggagcaaggcactgattttaagttgagataaaaaggagaagtcagtcaatgcctgcagccagacaggactcttgtaatagctagggagtatgcctcatttggatatgcatgactgccgggcaaggacactgccatgaatcgctaatggcagcagttgtatgacataagagagatgtgtatcagcaactcacaagttgactttgttacatgttatgaacacattcctgtgggcactcattcatagaagtgagaaatgtggacaccacagtgtcccaggcctttgttaccttatggcctgggaatatcttgctttgctggaacatgaagccacgtctggttataagaagaagtttgatctgggagcaaaattgcctgttcacgcatgtctttctcacttctttaaaactaacttgctataagggtgattaaaaaaaacagatgtcaggtgagagttttgctttgcatcaacttcctacttgtagaggtaataacataaaccttgcctggcaatcattatttgtcatccagctgagggtgtttactcttgagaaagaagtaatggacaaaattgacttggattctggttctatgtttcccattaattgactctggacatatacatgcaatttaatccatcttactaaaaacatgaccaactcacaggatgtaaattctattctatagaaagggctttccctcagtagttagtcaagggacggttcctaactcctgtctttattgagcttattttccaaaataaatgtattattttctactttgttcacagagcaaggcagcataaagaaattaagcaacaaaacaatagtgtatttttacccaactttctagaaaacacccatttttcttaagttttgatatttttttgccaacaggcagtcaaaaagaagataaataaaactgggttaagttggtaatgacacaataaataaatgagatgaagaaagaggcaataaatatgagtggataccaacaagaaacatgttcaagccctgaaaaaataatgagaaaaggtagaactattaataatacatcccgctctcgtatcacaccttgctccccagatacatcctatctgtcctggcaccatgttgatgctgttgttctgtaagctatgccaatgaacatgttggatgacctactccagctctacctcaagatttccaaataagaaaaggacccagggatctccttgctgaggtctttatccatttactcaggtcacaagtactaattaagcagctcttatgtgcaaaatgttattgcttcaggtcagtttttcctatactgctgttctataagagaggaagaaggtccctgccctcagaaagccctagaatacagatctagagatgggttcaacatctttgttatgcaattatttcattccaattgtaatgagtacttagaaaggacaaaagcagagtgctgagagagtataacagagggacttgacctggtgtagtaggcctggaaagtttcctggggaagtggtattttagacaaacaacacacacatacacccatgaatgtatacgtgtggagaatgtattctaagtaactatgatgaatgtatttcttactgtaggtcatggtcaaagtttgaaaactattgttctaactagtattataattccagggatagtagaggtcatgtgacctgtttagcacatgcctgccttaacagtatctagtaggccaggcaatgtggctcacacctgtaatcccagcactttgggaggccaaggcaggtggatcacttgaggccaggagtctgagaccagcctggccaccacggtgaaaccgtgtctctgctaaaaatacaaaaattagccaggtgtggtggtggtgcctgtagtcccatctactggggaggctgaggcaggagaattgcttgaacccgggaggcggaagttgccgtgagctgagatcatgccactgcactccggcctgggccacagagtgagactctctggaaaaaaacaaaaaacaaaaaaaaagaatgtctagtaaataagtcagtgccaagcaactacctgataactgttaccaccttagtcatcaccgaaggcagaaggtcttgcattcattggaggagagttaccaatctaagacatttgcatgaaaatgtgcacagagccctcacctgataatcaaagcatgttccaacacttctctttggataaaataagagttacatctcaatgaaatcacttgtggatcaagttctcatcctttcgtaaataaagagaggggcagcaagaaatggaagtgagcacatataagtgtgggaacctgtactttcctaacctataaagcattggatgtagtttttgctattggtgcgcatggagtcatgtggccttggagcagttaggtaccttccctgatgataggggagaaggcaaagaaattgatgatacatctctctcattgtcattccctagtatattacacttaaatctaactgccctattttgtgattgccttactgctgtggcttgaatatttgtgtctccccaaaattcatatgtggaaacctaattccatatatgatggtattaggaggtaggccccttgggaggtgattagatcatgagggcagagcccacatgaatgagattagaacccttataaaagagacccagagagctgctttgccctttttgccatgagaacacaagaaggtgctatctatgaacaagaaagcaggccttcaccaaacactgaatctgccagcgccttgatatcagacttcctagccttcagaattgtgagaaaaaaactttggttgtctataagccacccagtttatgatattttgttatagcattccaacggactaaaacattcattttccagaaaatctactccatttataagccagcattcttttttttttttttttaattttctacagatctctgcagaaacatgcagagtaataatagggccaggcacggtggctcacgcctgtaatcccagcactttgggaggccacagtgggtggatcacctgaggtcaggagttcgagaccagcctggccaacatggtggaaccccgtctctactaaaaatacaaaaaattagccgggcatggtggtgggtacctataatcctagctactcaggaggctgaggcaggagaatcacttgaactcaggaggcagaggttgcagtgagccaagatcccaccattgcactctagcctggacaagaatagtgaaactgtctccaaaaaaaaaaaaaagaagtgataatatatttgctgtatatattagttatagatagttatattgcagtactatcagaagctatgccacatattatttacgtatttcttaagatatagaaaacatccctcccctgcagtcattagtacttttgcattcaaacttcaaatgaaacaggactttagaaattataggcttggtgccatcctggccaacatggtgaaactcgtctctactaaaaatacaaaaattagctgggcgtggtggtgcacacccgtagtcccagctactcgggaggctgaggcaggagaatcacttgaacctgggaggaggaggttgcagtgagccgagatcgcgccactgcactccagcctggcgacagagcgagactccgtctcaaaaaaaaaagaaaaaaaagaaaaaaagaaaagaaaaaagaaattataggcttggtgatttctcaggcattaactcaagaaagcagcctttataccgattacctacattcacccagcacttaccccattaatttctaatgttgcttggaacaaatgaacattcctggaatgcaagctaaatgaaagagccccgaagaagaacagggcatttcctggttcctcatattgacaaatttaaaagcctgtgctataatatgggctcctgtttcctttcaagtttgtctttgaataagtggacagagtagctgaaagcagagtatttaaagctttgaaacgaccactttatttcagtctctgttcttgctgggaccactcttataaatgaggagattagaaaatcacctagaactatttaatcgttgtgcagaagaccctcttaccccaaatatttacttaccgctcattttattggcacactgcctcaaattccacctgctgtgaactgacctaagtgaatttaggtcacgtgcaactattaggttctttttgggaaataatggagaaccacagatgtgtttgaggtggatgaggaatggctacctcaagccgcagcttcatgcttcatgctgaagtcctccacaagtgcaatcatgtcgttaaccaacatttgttagaaggcaggcagaagtcagcttacagcctgttctacaatttttatgaagtgtaggattttaggcttaaattgacaccattgcaaatacagtattctcttacctttagatttggcatcaggtcacaagaattcttcctaagccaatggttggatacaaggccattggagaccagacgtaaaattaaaagcccaagcaacaggttttgctggattcttatatcctgtttatgcaatgttaggggatgtcattaaaatattttagttaatccatgtatcttgattgtcttaaattttactaatgagatcctatagggatattcattgcaatccactatttccctcagcaaaaacacatttgcgatatctattacatgcattacaaaatcctccaaggttcacagagatatatagtagtagcagtctctgggttttggcctttttcataagatgaaggctgtgctgtcctagaatatgaattcctaattaaaataaccatttgcctcaagcctctagagttgaaggttgcactaactgcacatataaaatatccaactatctatgttgagatatttaaaattaattacagatattgtaacaccattatttaacttaaattccattacaggtcctttgagtatgcaaaatatttctttgagatgtggtaacccctttaactgatcaggaaataaacctttattatcaagttgttatcccaccttgacaggcctaaagcgcagaccacatatcagaatcccctgggcagcttataaagctcctcatgcccaggctgcatctcagaccaattcaatctctgggggtgggctccaagcatcagcatttgttgaaaatccccaggattacaaagtgcggtgaagtttgcaaacccttgtaataagagaatgggaggagggatggctgtttgccaagcagaaccaggaatgaggaaggatattggtaaacaaaatttatccataattgacttttcatgaatcacagtcctactgagacccagccttgtctcatgagactttggctacgatgatgagtgagaaaaggactcctcctaatttaccagactcttgattagaagcaaatgaaattttggaaaagagacaagtcactttcaaaagaccccagcctgtacctgaccctacctctggactccatagtaatggcaggtagtggtcattcctggagtaactctgtatttcttaaaggaacatttgcataatgaacctacagcaatctggaagacgactggggtaaatagagaatttgttgattttagatggctgaatactatccgtgcagagcaattaaaaggacaactgtcagaatcaagtaagagaaaggaaataagagaagtctcatgttagtagaccttgtttgatcaatgtgttttcatcttgtatatgattaataaaataagtttgggagttaggatcaacctttgtttactcactggagaataacttgcatatagaatgaagctgggattgtccaggctggtttttttccatttggaagtttggatacaatacaaggaagcctgaattccaaactgtttctcttaaagagtgcctttctgagccgctattaaggaatgcttattgtttcgaaaatggtagcacagaagtgttataactagagtacaccttgtgcctgcaattaattacccagtgtcttcaaaaattcttgtcttttgctggtagaaaacctttgaaactatagttgtctgtggtattcactgcagcaccttagatataaagagagaaatttattttcagaggaatcttgagacagtttgtgtgtgtgtgtgcatgcctgcttacacatctattggttttccccaaggattgtagaaatcccattaaaattccagcttcttaaggagctactgaaactccagtttttcatattttcttttataatatttggatgcgtttaggtaaacttgcagcattttaattatgtctgtatcagatgagcggaagaaatgtaaaagggtttggggagagatttaattttagatagcggcgtaattaatagcatttggaaaaactagtggaactttaattaaatgtctctacattaatttagtcatttaattgaacatgtagtgggatagtccttacaatttttcacccttactctttgaggaaaaatgatttttgaataacaaagcatcagtatgactactttttattatttagctgtatgttcactacttggcactttgtttaatttttccccccatatgtttcgagctttttaaaacattaatttggcttgtcgcttttatcttaaaaactataaatctgggggccgggtgcagtggctcatgcctgtaatcccagcactttgggaggccgaggtgggtagatcatttgatgtcaggagttcaagaccagcctgaccaacatgacgaaaccctgtctctactgaatacaaaaaaaactagccgggtgtggtggtgcatgcctgtaatcccagctacttgggaggctgaggcaggagaattgctggaacccagggggctaaggttgcagtgagcagatattgcaccactgcactccagcctgggcaacagagtgaaactccatctcaaaaaataataataaaataaagaaataaagaaaactataaatctgggagaaaccgtatttggaaacattgagcaactgtttcttttcctttattttagactttaatattcactagagtcatgttgtaaagttttcaccttaatattgtaggctttttttttttttttactttgccaacttaactggcttttttaaagtggtgttatgctgcagcagtgtatctgaatttcagcagtgccttttacgtggctgctcacaatcttattaaactacatgaattatacatggagagaaatataatttggtaaatttggtgatgtttcaataaccatgcccaaggaggaatgttgtgttaaactgtcaatttgagaagtgttttgtggtgctaaccacagagtgaattcagttctacttcatttcacaaccctccataaatagtgccccctaaaagtggtgcctccttgcctgtactttgacccagatttttgtcatttttctagataagcatatacattgtgcacttattaatttttcaaatgacacaaaggtgagaatgggagtcaacacactgaaagatcaaaatcaagactcaaaataagattataacagactgggatactgtaccaaaataaaaaaattaaaataaaatttaacaagaacaagcaagatgtcctgcctttaagatttttaaagtcttttgtacaaatataggctgaggaacatctgactttgtggcgctttatatgaaaaacaaattgggattttaaataaccacaaggactgtattaatctccagtatgatctggtgtggcttactgtacgaggcaatacagtattagattgcattaatgaaattcacaaatgttccattaatctcttcactagttaaaccacatctgcagtcatattgacttatgagcatcacgtatgatgagaacactgaaaaatcataatacattgacagcagggcaaccaagattgtgaaaggtatagcgatggttatatgacaaatatttgaaagaatctagaatgttcagtaagaagataacatgaaaatacaggacagcttcttcatgcatctggggagggtgggtaaaggacacagcacacttaattaagtaagattgtagaagagaactatgggcaagtgttacagtggagcttactctgagtaaggaaaatgtaaacgttagagttgttattaagtggcatgggctgcttcacaaatttccatcattttttaatctgattcatctgctaataggacaaactgtaacaatagcttaaacaatagagaaatgtaggtctctctcatgtacaagcccagaactaggtagatcaggcctccttccgctattctgcttcactaagtccgaagtcctcctttaccttgtcctgccatggtggcctcaattctcgttgtcaccacatggtccaatatgtctgcttcagctccagccaacacatctgagttccagcccccagcaacatggaagaaggaaggaggcacagagagggcgtgtgccagcagtgttgtgagaaaatctttcagaaactgtcatgaaatgtatcccctgatagttccttcaccagaactttgtcccatgattatatttacatctatgtgaggctaagaaatatattctttccttcaggcatctacatacccaactgaaaattatgagttctattgccacaagaaaaaatggaaaatatatggggacaatcaacagtacttgcacaaagatgttttacagagaattactcttttacctgggaattttacaagataaactttaagatcctatcaactctctctctctctttttttttttttttttttttgagacaagagtctcgctctgtcacccaggctggaatgtagtggtgcgatctcggctcactgtaacctccacctcccgggttcaagtgattcttctgcctcagcctcccgagtagctgggactgcaggcgcccgccaccatgcctggctaatttttgtatttttagtagagacggggtttcaccgtgttggccaggctggtctcgaactcctgacctcaggtgactcgcccgcctcgacctccctaagtgctgggattgggattacaggcatgagccaccacgcccagccagatcatctctggaggcagggggatcacttgaggtcaggagtttgaggccagtccggccaacatgacgaaaccctgtctctactaaaagtacaaaaattagctgggtgtggtggcaggcaactgtagtcccagctactcgggaggctgaggcaggagaatagcttgaacccaggaggccaaggttacagtgagccgagatcgtgccactgcactccagcctgggtgacagtgagactctaactcaaaaaacaaacaaaaagagtctatgatcctataatttatagacaacatacaacctcctttctctacaaagagaattggttctcaagggctgtttggaaattcatttccttttaagtccaaaatgacatacaaaagtgaccaatatatacaatgtacacccttctacaataagttctcttttgttgccgtagtaatcgcatgtcttttcttaaaggaacacttttttgactcttttgtacttttgaacatagcggtgttaataataatatttataaaacattatgaaaatatgcacacaaaacacaacacaggctaagaaaacctaatggtggcctaaagtaagttctgatgtcctctgttggtggtattcttcattgccatgcttctgctgtgcctgggacctttattgctacctatgggaagttgtaagtagagaagtttctttactacagggatgtgaacaatcattgtaagtaaggaataatgaattcacataagttcacagagcatgtttttctgccctggtaatactgcatttctcactttgcatttaaagtacctacgcccttacacagaaaaagttatcggggttgggtgcagtggctcacgcctgtaatcccaacactttgggaggccgaagcagggggatcacttgaggtcaggagttcgagaccagcctgggcaacatggtgacaccctgtctctactgaaaaaaaaaaaaaaaaaaaaaaacacacacacagaaaaattagccaggtatggcggtacatgcctgtagtcccagctacttgggaggctgatgtggaagaatcgcttgaacctgagaggtggaggttgcagtgagccgagatcgcaccacttcactccagcctgagtgacagagtgagattccatctcataaatatataaatatatatatataattatcgattgattaatattattatatggtccccattactctaaactctcaaaatgtaatgtaggtcaaaatcagaaaaaggccatactgtctactccttcctctgtttcattccaactataagagaaagggagagggcaaaacaaagatgacaggaggccaaattgtacatagaattcatggaaattcttacccaacatgtaaaattatgatagtataaggaaaagtatactgcaaaaattaaacttctacattgtgaaatggagaacatttttacatctagctctattgcttctccctgtggagctgttctaagcacaaagttcccattacataatgaacaactccttaaatactgtgcaactatttctcactagaagcacgatgcagcaaactctgtttctcagtaaccatttatatcatacctagtggtaccgagttctataataaaagggtgatatgtgcatattttgtggtcatagagtgcaaagttgacatctacagtttaaagcattgcattgcatgaataaggtcaaaatttaaatacttttctatgatcatgttctttacattaaaggttaaagatgcatgccgctttaaaaatggtttaagggccggacacggtgactcacgtctataatcctggcactttgggaggctgaggtgggcagatcacccgaggtcagacgttcaagaccagcctggccaacatggcaaaaccctgtctctactaaaaaatacaaaaattagtcaggcatggtggcgggcgcctgtaatcccagctactcgggaggctgaggcaggacaatctctggaacccggaaggcagaggttgcagtgagcagagatcgtgtcactgccctccagcctgggcgatagagcaagactctatctatctcaaaaaaataaatgaataaaataaaataaaaatggtttaagaacttcaaaccatctggcaccagaaaacacctaaattgaattaaaaatctggaaatttaatttcacaacttgtcctttttcaagcctaccctaagttttgtttacttaatggggagaatctgttttatttgttcctatgtagaagactgctgattttatcatgattgtattagggcccaaggatatttaaaatatttcagtagctattacttatactttatatctgcattgcactttagagttgactgagcattttcaaagtattatcttaccaaattgccacaatagtcttgagaggctagtaaatcatgggagaagcccccatttccccactggaaagcagagaaaacccccattgtagtaaaggaggggttccctccagagctcttgtggttgtgttgaggaggaagtattaatgctgctgggcatgacttacaagaaataagtcaattcacttaagcaaaagtgctatgatcctgtataccatgtgagcagctctaggatggggtcacccagcattttggagcagacattagaacatctggagggagtaaacgcaaagaaaatgggctagatacctttccttggatgggaaaggataacattaagataccaagatcaaatgttcaaagagcacatatacaccagagaatactatgcagccataaaaaatgatgaattcatgtcctttgtagggacatggatgaagctggaaaccatcattctcagcaaactatcacaaggaccaaaaaccaaacaccccatgttctcactcataggtgggaattgaacaatgagaacacatggacaaaggaaggggaacatcacacaccggggaatgttttggggttgggggagtggggagggatagcattaggagatatacgtaacgctaaatgatgagttaatgggtgcagcacaccagcatggcacatgtatacatatgtaacaaacctgcacgttgtgcacatgtaccctaaaactttaagtataataataataaaattttttgtaaaagcattgtataataaaagtagtaagataaaccagtaaaaacaaaacaaaacaaaacaaaacaaaaaaaagttcaaagaggccgggtgcagtggctcacgcctgtaatcccagcactttgggaggccgaggcaggcggatcacttgaagtcaggacttcgagaccagcctggccaacacggtgaaacctcgtttccactaaaaatacaaaaattagctggatatgatggtgcgtacctgtaatcccagctacactgaggcatgagaatcacttaaacctgggaggcagaggttgcagtgagctgagattgcaccactgcactctaatgtgggcaacaaagcaagactctgtctcaaattaaaaaaaaaaaaagtttaaagaaaaataagttatttctccatgcttcaggagatatgtttcgcaggagaaagaggcttaatagagaaaacagatccctacaaacatttgtggtttttaaaactgccccattggttactaagtggataacatgagcgtgatgccagattcagtactctagtgagccatgcagctttgctgtgctctgcacctgatgagtgtggcctcacttcttataaatgcctgtcattgctaacaggggtccttgctgaaacaacagggctggactaatgctctagttcccttcctggaaaacctatcccaaagctgagatcctcatgatgccttctctcatatatgaatgattgcaggttacgctatcatcattaaatcgaaacattttagaccactttgcgtttgtttgtttgtttgtctcattatgtccagttttatcctgtttcataatttaataaatttttattgggtctgtcttctggttaaatgttgtgtgtataaaaaataaagtcaagagagagaacaggagttatggaactaatgacaaatccatccttcagctaaataaaattatactatggatgatttgagctgtacgttgagtgataatttttaaaaataagatagatcgggtgcggtggctcatgcctaaaatcccagcactttgagaggccgaggcggatggatcacgaggtcaggagttcgagaccatcctggctaacatggtgaaaccccatctctacttaaaaaaaaaaaaatacaaaaaattagccaggcgtggtggtgggtgcctgtagtcccagctactcgggaggctgaggcaggagaatggcgtgaacccgggaggtgaagctcgcagtgagccaagattgcaccactgcactccagcctgggcaacagagccagactctgtctcaaaaaaaaaaagaaaaaaaaaaagggccaagcatgctggctcacacctgtaatcccagcactttgagaggccgaggtgggtggatcacctgaggtcaggaattcgagaccagcctggccaacatagtgaaaccctgtctctactaaaaatacaaaaaattagctggacgtggtgacaggcacctgtaatcacagctactacggaggctgaggcaggagaattgcttgaacccaggaggcagaggttgcagtgagccgagattgtgccattgcactccagcctgggcaacaagaacgaaactctgtctcaaataaaatgaaataaaataataataaaaaataagataaagtatcacaagtaagatgtagttgaaacttcatgcatttttctatgatgcctatgatattcaaaagataactgaatttcatgagcagagttcaagaacttctgagtatacttttcattgatgacttaatgtaatggatttctatgatgatggcactatattcttttggtgtttatggtattaataaaaaattgtggtaaagcttgtggaaatgaacatgccttggattagggtgccttaaatgtgcctttgtaaatgcagctaggagactccaagtcacccttctagtctaactgctactcctttcttttacaaactacatgccaactaaactgaccttgatctgtttatgaaaaggcggtataggaacaggggctctgcaattggacagatccaattctaatcaatccactccattgatagatatataaccttgagtccttcctgtgcctcagtttcctcatctgtaaaatggaattaaaaaccaacttcgtgaggcttttggagaatgaaaatgacataactcaaagattattgggtatcagaaacaataatgttatctatcactgtctttactgttattattattattgtcattattattattttctctacctggaacaccaattccacaaactcttaatgtcaagaccatgctgtatcatggagccttccctgattcctccatatgaaaataattaattctcatattaataatattacttttctagttgtattttctttttttagcttttattttaggtttgacggtacatgtgaaggtttgttacataggtaaacacatgtcatggaggtttgttgtacacattattttatcacccagatattaagcccagtactcaatagttatcttttctgcctactcgtattttcattatccccaagtatactatacatatcttaaaattaggatccatgttgaaaaaacattgatatttcctatggcttctaacacagtacattgcacttagatattcagcaactctgtattgaatgtatgggtacaatctgctcttagtttctaatttggtattaatatgttcaagcctcaagagctcatgtaaatgatggtttgactatattgcccatcttttgttaagttgaaaagctgaaattcatgcactgtttgttagtgtagtaatttgtgacaacgtctagctattaagtcttttctaggtataaaacctttatatctgtcattgttcccctcttgtgtttttgctttaatatcgttgaaagcatctattattggaactttcacttctgaatagtacttttgagaacctgtatagaatttcagaggccttagaaaattgtcatagattgcttttagtatatggtttaccactgtggtctcttaacttttcaaaaagtatttccaaagggcacttacatccataagtggaaattgatttacatctattattgctgattgttcactattctgaacttcggctaaacaggtgatttaggcagaatttttttaaatattagattttttcctactttctaaatattttgtagctctttcttattaatttgagtcaacttatgctcgcttttttttgtcaattatagatggttgtcaggggtttggcaaatgtcatatgaaggtaattctttaaaagttgggatttttgaactgtttatttctactacttttgattttgctggaaattatcattctattaaagggacaaaagggtgctcagaaatatgcattgaaaaatttcttacagatttatcaaccattgccctcaggcactgatattcagccagtatgttccaatacatccatgtctttccattttaaaccttttaattctgttctaatttttcattgcctgtgcctgattgttctgtatccatctgatacgaatggttaagtacaacattttaaatatcactcttgcctatacatattatttttcttgtcagatgatataattgtagtcattacatgtttcttaagcacaactgaaatcttaatttaaatcaataagtcttgtttctgtggccattgtttcccagaactctccggatttctaagcatggtggttattcttccaggaatagtgccgagagtcttcagcagcatgcatttctctctaattgacattatttcacactctccattttccttactattgaaaactgtatttcattggtattttgccaaggatcctgctctgtttcataataatgttctgttcgcactctctgcactgacaaatacctattccatgcatcaattgcataaatggcaatttgaaagcatttaaccacagctggatatttttcattgattcttttcatctgaagatcattcattaggcttctccctcctgtttcttctcacatccatacctcctttcctcctatgtacatagtgtcttttgcattttctgtatttaagtgtaaattgctgactacagttatgcttttacctcattccatggtcataatgaaatcacaaatttaaaaatgtactactttttaaacctgttttctgacttgtccatctaaatgcaattttataattcttcgacattcagcctcctggtgaatgatttctgcaatctctccaagacatctgtgcagtgttatggattatattgattgcattttgtccatgttcaaatttgcagaatgtaacctacagaatatatattgactaataaagaaatgcatccacatggtggatggttgtaaagagaaaatatatattggtgtgcagcaggcgcccacacaaatgaaatctagaaaacagcagcttgccatgtcagagttgcaaatgaaggctgtggctacaaaacacagaaagtctggagtgtatgaaaggtttttcttccaaattcattcacacataaaaatgaaaaaattgaaaaatcatatatgtgcaccttaatttttatatcgcattggtgtttgggcatacgaccctgagattttcataccctcgatttttttaatataaccacctgagcgtttcttcccatggggttactttagaagatggggggtgtacacactacgtatgtatgtcaataaagaaatgaaggaataaaggaggaaagaagtgaagaaggctgggggtaggaagggagggagaaattcagtgattcattacttattcatcatcctaaactggcatataaaataatatgtttaaatcagtctaaaattttcattgtataatctctgaaataactagtccccactccctaaactgtttggtgtaaatatttatctatgtctaatcatttctatgcaaaatagccttatatatattttcattttcataagatcatctaagaatcaaaggaaaagctattttaggcaatgaacataggcagtgatttcaaaatagaatttgagaaatgcaaggatagatggaatcacaaaagatgatctcattcatggtgttttaaaccctacaaatagatttctgtttagttgacctcatttcaatagcttctcatttttttcagaagtgtatttgatgtgtatatttctaataaacttatttttctttttgtacccagtattaaggagcacagcatttatatccactgaacaaaggataactgaaaggaaactccttgatatccaacttggagtatttgtttctcgaatgaatatgagtttatataagtagtttttttcacatacataaaattagaatttgtttgtattattgatattatttcagaacagcggatttaacgtcatagatgatctagatgtgtcctttccttagaaatctttaaaatgaatcacatagtctagaaacagatccagatactacatgctctcatcagaaaggactttcttctcttcgtgtcaagttcagtgttggcaccgtatagacaaagcgtgttaaaatagcagggttcttgttctctgacacattacaagagaggcaagattataaaactgctatgtgtctcattataattcccattagtttcatttgcttcaaaacattcacttctgtgctttttgcaaaagctttcaaacttattttttgatgattctaaaagtaattcttctatgtcttttcctagtgatactagcattagttttcttttccaattgtactaggaggcatgagagattatcgatgccctattttcttgtctaaataggcaacccaaataatcatagtgacctgttcatttatattatctttatttcttgcctcatacttcttcatatttcttcatttcccatgtttccttattctttggagccagaaacgatcacgttaatcactctttccattagttttctcctatacattttctgatctttctctgagccagttaagagtcattcagccatttgataatggacactagtttactttgaccttgcaaacacaaataccctgtttgatctttatttgctgagagcagtaagacagaagaattacaataaactttttagcacccttctgttcaattctttttcagaaatcgttccctcaaaaagcctattctaggctctttcttttggcagtttcctagaattttcctttgcttttcaccaactggaacattatcactagaagtaaactaagggaccatctaattcaacaccctcgttttgtactttaggatactgaagccaagagaagctaatttttttgcctgccataacacaactagttagtgaagcagccaaaactataagggatcttgccaccataagctttatcggcccatccgtttatctcctcaaagcagccctatacctgatttccttatttctgttctctaagtaagccaagctcagaccttagagtgaccttcccctaatccaccctgcctgacatccaataaactgacaaatccagttgattatgaagctacagtgtttttcaaaccataccataattgtctaggctgttgccatgctctacacaccagttttcttattccagtccctccctgccccagtcccagttcactctactcagcctctctactgcaatggataaaatcacagtttccagattcacaaagctcacagctctgccactttctagccttgtatttgtgtttcagttgctgctgaaactctctaagcctattttccatctataaaatggaaaccaacccagaggctcgttgtattacagagatattgcatgaaaagcatttagcgcagtgtctggcccataagaagtcctcagtaaatagtagtcttggggaagcagtagggtgttgtagtaagagagcagagcaggggacagcaaactacaggtctcagtacaaattcaacatggggcctgggttttttttaatagcaggggagctaaaaacagtttacttgttttaataagttgtacgaaacccaaagaagaatatgtaacggagatttatgtgttcctcaaagccagaaatatttactttctggccctttacagagaactttcattaattcctgttgacagctgtcagggtatgaatcctctctaccacttagaaactgtgtaaccttgggcaaatgttttaacctctccaaggtttggtttccctgactgtgaatagtacctatgttacagggttgttatgagaattaaatgagatcatttatatcaggtgcttagctcactagctgaaataggatttaataaatgttagctgacatggttacgtctactcattgttgcagataaatagcctctaagtgcagctttaatagtgattgtttcttaaaatttttgaacaaagtttttctatttcttatccaattaaataaatattccacattctggcattcaatatttctaacgacatcaagcaactctaaaatcattgaatgttttaaagcaacaggaaaccttagaaataactcatctaaactcatatcatagatatggaaactaagggccaataaaaccaaggcttctaggacctgaaatcagatcctctctttttaggtagtgtgatcttcatcgtgcttctgccatgcaatctcagaatttaaagggatttaagaatcattcattttcttcctaaggcaggattcgaccctataaaatccctgtcagtttggtcattcaaacccagtttgagtacagtcattgatgataaatcacccttttcccagggagcagttctggttgtttcaaagtctttataataaatgaaaattggctttcctgaaatctctatatattgatctattcctgcccactggagccaaagagaaacgtcacttctctacatctgtaaaatactcgttgtcaattttcgtatcttctctaagcatcctcgtttcaagctgatgtgaactagttgggtttttgattgttttcattgtcctgctaagtcgaaaagctaagaaaagcttggctctttcatcactgttatatatcccactgtgtaacagaacttgagttcagggtatacactctaaataactgcttttgtaaaagtattcaattatattgatttttttcgttccctctgttgttcctcataattaccctcagtcaagactttcatcttcgtctttatcttcctctgcaagaattaacagtggtcccttttgtgaacttcaaatatctgagactggtctcagttaatttaggaagtttattttgccaaggttgagaatatgcacccatgaaacagcctcaggaggttctaacgacatgtgcccaaggtgtttggggcacagcttggttttatatatatttagggagacatgagacatcaaccaatatatgtaagatgtacatttgttccatccagaagggtgggacaacttgaagcaaggaggggcttccaggtcacaggtaggtgagagataaatggttgcattcttttgagtatctgattcgcctttccaaaggaggcaatcagataagcatctatctcagtgagcagagggatgactttgaatagaatgggagacaggtttgccctaagcagttcccagcttgacttttccctttagtttggtgattttgaggccccaagatttattttcctttcacactttcaatataagctatccagaactgatgataatattccagatatggcccaaccaatggaaatgattgtgtttcctacataccatatcacaatcaaacctgttttgcaccttgcatttactttctttattaatgatgtcattgcaatttagaaaatttggggccacatttacttcttcctctctattatcttcagtttttatttggtcactaaattctgtttgctgactcttatatctaaaaataaaaacactcaaatccagctattcctctctaactactctgcccttccctcagtcctttctcagtgactattaatgatttggccttctaatgattagcctccctgtccccagacttttatccatctttatcactatggctagttatcttgctaaacaacagatctaatcctagtaccccattatattaaaaaaatcttctatagctacagctttctctccctccaggtcagtatccatagcctgtcaagatgtggctttgataaaggacagaaggcagggaaattctgggcagaagagggcaggtccccattgaggacccaccctcaagccaaaaagcctggaaccatggcccaaagtgagaacttacatccctgttttccctcttgaagggtgccttttccaaaaccatccattaccccccacccaccccccaacctgtgcctataaaaaccccagagctcagctggcagaaggaggagaagcagatggatgtcagaaactacagttggacatcaaagagaagcggcttgactttagagggacagtttgacagcatagctttggagaggagtccagctgtggatggtcagactccaggggaagattaccttcccactccatccccttttcagctccccttcccactgagagccactttcattggcaataaaatcccccatatttaccatcttcaatttgttcatgtgacctcattcctcctggatgctggacaagaacttgggtgccatgcgtgtgggtgaaaaaggctgtcacactgaccctccactgagctgttaacacttaagccatctgtgaatggcaaagctaaaagggcgctgtaacacttcctcatgggcaccctcccctagaggctgctgcagggcccgtacggtgttcactcttgccagcactcaaaaatgctggccccagctgctgcacctgctcacctgtgctcccccttccatgaggggtggaccagcgagtgagtggagtttgctcccctccagttcccacccacgaagggatcagggaaatatcctccttcagctccagtgaggcacagtggtatacacctatagtcccaactactgaagaggctgaggtgggaggatctcttgaacccagaagtttgaggctgtaggcactgtggttgtacctgtgaatagccactgccctccagccttggcaacatagcaagatctcatctctaaaaaagaaaaaatatatatgatgtggctccaattcactgatctagcctcttaactgaattccttcctcctggctgggcacagtggcttatgcctgtaatcctagcactttgagaggccaagacaggagaattgcttgagcccaggagttcaagaccagcctgggaaacatagtgagacttcatatctacaacacattttttcaaaaagaattttttcctccctgctccccaccctacccccttgcaaccttatttactcttcggcctctggccctctcgctatgtctttctcagcttcatgcctttgaaaatactctttctatgcctggaaagcccttataaacctggaaattcctattcttattcaactctgagccagtccattttagtggcttagttcagaggctctagatttaaattgcaattctgtcagattctgtctgctttgccaacctcaatcaagttatgtactatgcctcagtttcctcatcagtagaatgaaaataatacagtagtgcttttttcatagggttgtagtgaggattaaatgagatgaagcgtataatcctcatgtacataacacagtacatactatatgtgttgcacatagtaagtgctcagttctttttctttgcattattcttagcacataagtcaagttacatttgctctcccttacgcaaggtcaattgttcttttttatgtgtttacccgttactttgttcatgcatttgttataaccactgccatcataaagcaacttgctatctttgttcataaaacaaatcccagattcactgagctcaaagtgagagaaggaaactttgcattatgtgcagttcctatgcttttctccaaatttcacatctccgttggggatctctcactagttatccttgccatacccccacaccagccttacaattttgcattatgtttcctacatcatgattctaaacggtcctcctgttcgctttctctccatcccatatcgttgcagatagctatttcctctttttaagacagaaacacatttgcattttgcctaagctacatttgtaaattttacagtattttcgaaagacacaatggaatctaggaaagatgcaacagataaagagattaactggccaatttttgagagcaccatccgtaaagtccacgaacaagtgaggcttccttgtcggagaaagcaattcagtcaccataaatgatcattcaagcctgatctcattccctcttgaaactggaaattgaaagcttgttcctctgacagttgtgttgtcagtggatatgcccagtgtgcaaaggactggacaaagggcaaaagtacacatatcccatctggaattctgagtcatccctgagacatcattttggatttgtctactgagatgaaattaaaacatgagtaatcaagcccacacttcttccccctcaaactcatctctttggtatcatcaagaaaatcaaatgctaatagccattgacctcctaattctagtgctcttagctatgataaaacagtcattaacttaatctaaatgttgcaaataaaggagccccatcaaagctgaagccccaaaattatacaaatgagttaactgggaaggcatgggggaaacaacagttttcataagacacactctaaatctagtttattctcttaggaagacttttctcatcaatagagagccacataaagatgccttacctgcctttcacggggactatatcaattggctgtactgtcactcactccaaaactctcaaaatgcctaacacagattcttgattttattgattgcattagatgttacgttttctaaattttcagcaccctggaggtcacctcaggaaatcatgcagtttttgaatgattttccttagaaatacacgtgtagctatacatatgcccatgcgttatttaatcagttagtgaaaggaggaaaacagcatttctattattgacctttctcaatctctgaggagactgtatgtcttgcctacagtccaggattgaaagcaaaagaaaaaggcactgacaaaatagcattttattttaatagcacattatggagagacaaaaaaaaaaaaaaaaaaaaaaaaaccctgggatttcctttgtctaagtagaattgacgtatgggtgagatcagtctctattttactcagtacaagtgcacacatatttatgtacacacatataattgtcatctttgggccgggcgcggtggctcacgcctgtaatcccagcactttgggaggccgaggcgggcggatcacgaggtcaggagatggagaccatcctggctaacacggtgaaaccccgtctctactaaaaatacaaaaaattagccgggcgtggttgcgggcgcctgtagtcccagctactcaggaggctgaggcaggagaatggcgtgaacccgggaggcggagcttgcagtgagccgagatcgcgccactgcactccagcctgggccacagagcgagactccgtctcaaaaaaaaaaaaaaaaaattgtcatctttggaagctaagggccctgtatcagagtatcagaatatacctatatccaggatgcaatgttctccagttttgcattaacatcagctacaaggttcactgccatctaagactaatcaacagtaatagctaaaggacaaaggtcagttcctgagagatatgcctaaattcatctggctatatcttctgttcctcccaaaccctaaccccataaattcttcattgtttagaaggattcatattttttgtttgtttttcatattcccattttattggctggggttagaattgcaatggcagcaaaaaacacagaagctatctacagtggcttaaataaatagagttttatttatctccaatattaagatgtctggaaataaggtgctttgggcccaacagtatcaggactggcatctgtatattttttattgacttttcctcatgcaatatagcagccaccattatttcacagggtgaaaaagagaaggcaaaaagggtgtactatctgagtcttatcatttttataaagccaaaaatttcccagaaaccttttttgaaagacttctacttgtatatcattgtgtagaactgtgtcacatgacagccaccaacaaaaagatggctagggagaagtggttttcaacaggtattgaagtagctaaccggcagtgtctgccggtcttcagttataaacaccagcagctaactctggctaattcaagtcagggaaaacaaaggggatggggtaggggctctttatttaaaagatactcatagaaatgaacgaagtaatttgaaaactaggtctcagaataggacatgaagtataagagttctaaaatctcaaaagcaggaacacatgcatcttctttttaagtgttgtctttgaaatactaagctccaaagtctttccaaccttgtattattttcttcctttgtcagcttcctgagtggcagagtctgagtaacctatggggtctttgaactctttaggggaattgaggaaggcaaaaaggtaccatgattggcagctctactagagtcacaagaaatatggggaaagcgattcctcaaaggaaaaacaaaaacagaaacaacaaccaggcagttagtagaaggatgaaatactggacccacaaagacaacatatgtcttctcaccacacttggtctctctctctctctctctctctcacccttctctctctctcatagtaatgaaactaaagctgcaaaactaaggcctagctattcattgtgatccttatgagatcataaaaaaaatctgtatttaagtggagaaaaataaatggaatatcaactttaaaaaattttttttgagacagagtctcgctccgtggcccagactggagtccaatggcatgatctcagctcactgcaacctctggctcccgggttcaagcaattctcctgcctcagcctcctgagtagctgggactacaggcacgtgccaccacacccagctaatttttgtattttcagtagagacagagtttcaccatgttggccaggctgttccgaaactcctgacctcaggtgatccacccacctcgacctcccaaagtgctgggattacaggcacgagccactgcacccagctggaatatcgatttaattgtaagagaaaaatgcactagtttaaaaatgtgtcctctttatcctcaggttttaaaaatatttttaaggtagtttagaaaaactgaagtgattatttgataaataaatttcaaatgctatcaatggaacaagaatggatattagatatcctgctaacaaggatcatatttttacaagttgtttctccaaagagaacagagctacagctgagattctggtgcgcataaacctttccatcagagctgtagtcacctaacaattcttatatcacaatcttcatatctcaatcccttttccaaataacttcatctttcttaagttgcatacaaatgttataatctaatatttttgagatggatatcatgtgtcataaaaagaaagccattgtaatattaccaataccaagtattagcaaatattgacatagctttagaataaaaataaacagagctcaggttctggctctgccatagctagctagatttatcttaagacttcagtttcctcatatacaaaatgttgatagtatcatcatcttgtaagccttgttgtaaagagcaatttagctaacagtaacagtgtttaacatgcataaagtgaagactcctttctgggctgataagaacgctagtttattcatttgcttatttctatatttttaagcttagagtctgaaaattttcagagtctgggagtcaacgtgtggggtgtgaattggaacttcaccacttactaacaactcccttttgtagtgcttccatttatttatctgttcaataggagtaataatagcactcgctcaaagagttgtctgaggattagatgagacaatgcttgcaaaatgcaaagtggagcacctggtgtatagttggtattcaataatttctagttgttgatatgatgatgacgatgatgatgtattctcttgatatgtgaatgctcatcacaccatcctatggaatatttgattttaagaaaaagttgggtttgttttttttttttgtttttttttttttttgagatggagtctcactctgtcgcccaggccagagtgcagtggcgcaatctcggctcactgcaacctctgtctcctgggtttaagcaattcccctgcctcagcctccagagtagctgggactacaggcgtccgccaccatgcccggctaatttttgtatttttagtggagaccgggtttcaccatatttggccaggctggtctcgaactcctgatcttgtgatccacctgcctcggcctcccaaagtgctgggatgacaggcatgagccaccatgcccagccaagaaaaaatattttaaacaagttaagatcatttactatactgtgccctaagatgaggtgaacatgtagatcatgagatctaattgattttagatgcagttcagttttttaaaagaatgacctgctttccatattaaaatttcaaaacaatgatatgtggagatgatgacagaatatggctgaatgaggtaccttgttatcctcaaccttttggctcagagacctcttccttgctggaaactttcctaaccttttaatgatttattaacattttgcatgcactctttatacctttcattaatgactagttcactgcaaatttttctttgctttatttcctattcttggtgtgacattcattctctatctgtttctatggaagcttttgtgatgcctcagagagaaagaattctgagtctttgaaataatgaaaacattactaaaccataaaacctagatttcaggagcctaatagaggattagagctttattacgtacagccatcttacagtttagccttcaagtctcaattgtggaatgatcttttgtcctttctctccagtgtgcatgtgtgcatacacatatagacacagttcgcgcttcagtcatataaatgggaagccacaaagcttcctagagtacccagatgcagaattagaagacccaatcttgacaccagggtcaggggatctgtggtttggggggacttgtgctggctatattgttgtcacagcaggaacagtttgtgtcggtatagaggctttaacttctagtaaagggatatataatgaaaatgtaagcaaccatcgtttatttttctcacataataggaatttaagagaaagatatacccaaaattggtttattagctcaacagtttcattcagaatccaatgtctttccatctttgcatttgctatccttagcctttggctttggtctttggaattgtcacgcgatggttataaaatggctgccacactccaggaattgcatcatgacagtgtgaatggaaaataaaggaagagtggcagttcttgtcatgtttcagaagcaacagcatgtctccctaacatctctttggccagaactaggtcaagtagctgcatctacctgcaagggaaactaagaaattgactatcagtgctttttaaacttttttttgtgtgtgtggaaatagataatcactagagaaaaaagggagagtggaatggttgttgatgaggcaaccaacagtgtctaccactctatttataaaccttttcttgatttttcctactaaatgtgtggccgttttttttgcttgctttttgttttttgtttttgagatggagcctcactctctcccccaggctggagtgcagtggcgtgatctcggctcactgcaacctccgcctcccaggttcaagcaattctcctgcctcagcctcctgagtagctgggattacaggtgtgtgccaccacgcccagctaatttttgtatttttaggagacatggggtttcaccatgttgatcatgctggtctcgaactccagacctcgtgatccgcccatctcagcctcccaaagtgctgggattacaggtgtgagtcaccgcacccagccaatgtgtagccttttagttcaaggacctttcattataaatcttcatagtccaaacacccggcatattgtctggcacaaaataggaagaaatatttttggacgtgccaaggaatttgcaagacagtgagacaaatagccagtaaaaatgttagcattaatatattattaaaaatagtgagaaatgctccaggcgcagtggctcatgcctgtaatcccagcactttgggaccccgaggcgggcggatcacttgaggtcaggagttcaagaccagcctgaccaacatggtgaaaccctgtctgtacttccagctacttaagaggctgaggccggagaattgctggaacccaagaggcggaggttgcagtgagccgagatcacgtcactgtgctccagcctgggtgatagggcaagactctgtctcaaaaaaataaaaataaaataaaaagaaaaatagtgagaaatgttatgaagacaaagaataggctactttggaagaataatagtgggaacttcttcatagtctaggaaggcctctctgaaaaggatatatttaagctaaaatctgaaggttaggtcagtcatatgaacagggaggggaatggaataatattttcaagacaatgacctaaaaggaggcaagtatggctaggagctaatgactgagggggtgagtggtacaggacaaggctggagagtttattttatgggtaagcagagaaataatataatctgacgtacctgtgaaagtacacctgagctgatgtacctgcaaaacatcatacaatctgatggacctgctgtataaatgagagattgaatgtggcaagagtagaagcaaagaggccaggtaagaggcatttgcagttgtcttgatgaaagaaaatgactactgggagtaagatggcggcaatggaaatagagagaaatgaacagatttgagatgtattttcgagacaaaatctgtatgacttggtgatggattagatgtcaggcatgagggattgaggatgactcccaagttttttttgtttgatcaacttgttgtactgtttgctgaggtgataaagatggaggaggaagcagatttggaaaagatcaacagttcagttttagacatgttcagtttgaaatgtgtgtgatatgtccaagtgcagaagtcaaattcaattatagctcaaaggagagacccgagctagaagcgtaaatgagaaaaatattgatacaaaatggaatttagagcatccagaatggaaatcacttagcatgtaaagagggaagggaagatggcctaggaccaaaccttgataaacttcaagaaaaagaagtcaagcagaggtaggagaagagaagtcagtcaaaaatcaaaagaatatgacatctcagaattcaaggatgtgaataaatgtgtaagtgatggatggctttcggtctgggctttttgttttttttttccattttaagttccaactttgctacaatccggctacgaatcccacaccctcccaaattatctgaggatgttaattgatacttgatcagaaagcagtgatttttaaaatcatatacttctaaattatctgagatatgaagcaatgagatagggaagtggctgaaatatgtttctctggctcagctgtcatgagggcttgctctagaatggcactcaagcacatgtttatccactgagctctatatcatttattccattagctgaagaaggaatctctcacactctaacttcagttctgttggacatgggaataaaagttagatgtatacagactaaactaaacagatggtagaaaaacaaaggattcttaaagtatattggagaaatgcatttctatggtcaattttcttgaatatcctaagatcaggtttcatgtatataattctttacatttcacaaagcacctttagatgtgtctattccatttaaccctcatcctaactgtgtgaagtagggcacagaagtgtagaaatgattttttaaaactcactaagctaatcaatggataatctgtgattataatagaatctgagtttcggcatctttatcttattccttactgcactatatctggaatggtaaatattgttcatctcacaagcaagctcttattgactgatatcagctgcctagagtggtttattgtaaaagagcataaagcaaattggggaagactacaatacagtgccataggctgattagtaatttctaccattggtattaaatgagaaaataatggtacaagtgctttacatttgtctgccattcctaaactaaggcacctcctgttatttataaggaagaatattctgagaagtttaaaagtctcttgttaaatcatttgatgacgttggataaaatggcttaaaataagaatatgcctgttgcacaaataatctacactcccccaagataatgaataagtcagctggagcatctcaagtttcaatatgtagaggatcaaaatgaaatagtcataaaaccccttgcagacatttcttgggcaggcaaactaatttcctagtaaaagaagttggaagttggacaaattgtatatgggaactttctatactacttttgcaaattttctgtaagtttaacttttcctaataggatgctgagattcagctcttccaatggtctcaaatgttttttggttttgttttgttttgttttttgagacggagtctcactctgtcacccaggctggagtgcagtggcgtgatcttggctcactgcaacctccacctcacgggttcaagcaattctcctgcctcagcctcccaagcagctgggattacaagtgcctgccaccatgcctggctaatttttgtatttttagtagagacgggattttgccatgttggtcaggctggtctcaaactcctgacctcaggtgatccgcccaccttggcctcctaaagtgctgggattacaggcatgagccaccgctcctggcctcatttaaccattttgactttcactttttctgtcttcaaaatgaggtattgagctaggtaaacttaatgtcttttttcgctttaattatctaataattctgtgattctcaacttggtgtgttaaaccagattacacctaagaaaccctgaagactttttagctaggagtttaaatattcacttagtcattcaattaatatctattgtgggtctgttatatgccaggcgccattttaggtattgataataaagcagcaaacaagacaaaacccctgccctcaggagagcttacattcttgtaaagaagacagatgataggccgggcgtggtggctcactcctgtaatctcagcactttgggaggccaaggcgggtggatcacgaggtcaggagatcgagaccgtcctggctaacatggtgaaactccgtctctactaaaaatacaaaaaaaaaattagccgggcttggtggtgggcacctgtagtcccagctactcgggaggctgaggcaggagaatggcatgaacctgggagctggagattgcagtgagccgagatcgtgccactgcactccagcctgggtgactgagcaagattccatctcaaaaaaaaaaaaaaccgaaaaacaaagaagaaagatgataaacaagtacacaattatcatataacaattttaaatagtgacagcatgttgaaataaataaagcaaggaagacgctagagagttgttcatggaaggaattgtcattttatataaggtgatcagggaaggttccactgaggaggtgacatttgaggaaagacctgaaagaagtggggagggagacccgaaagttcatgaggaattgtgtcccaaacagggcaacacataaaaagtccttgaggcaagactaagctgattatataacatttaaaagaattaggccaggtgtggtggctcacacctgtaatcccagcacttttggaggccaaggcgggtggatcacctgaggtcaggagttcaagaccagcctggccaacatggcaaaaccgcgtctctactaaaaatacaaaacttagccaggcatagtggtgcatgcccatagtcccggctacttgggaggctgaggcaggagagtcacatgaacccaggaggcagaggatgcagtgagccaagattgcaccactgtactccagcctgggtgacagagcgagactctgtctcaaacaaaaaaaaaaagaattaatttacatatcatgagatcatctagtctaacacccttactagacaagttcaaaaaggttaagacttggccaagatgacacagctatttaatgtgatatctgggttagaattcacctcatctgaattcctctcaaattgtgctctttgaggtcaatgtgccttttaaaaaatgacagaaagcatggctgtagatttcagatcataccaaatttgatggaacaatgaccatttttagcttcctatagagtctaagacttgaacttgccaagggagtcacagctggatttgtaagcatcaaatccacaaatgtacttaatgtcaaccaaggattttgtgtcacctgtaatgctcccccaggaagcccccaagtccactagtcctaatcactgtgtttggcttcataacctgttggcccaaacattacgcaaaaaagagcaatattcccaaggtggtcatgttagttgtggtgagatgtcaaccataagtagatctgaccgaggaaatgccttaaggaagcagctcaggaacacctgagtatatgtgtctagaatgaagcctattaaaaaaactactgcagagctaaagacagctgaaagccattatgacagtcacaactacttgatagattgaaaccaaagagttcctttgtgattagatagatcaggactctaaatcatgtttttacttcatgtgttcattcattcatcatacagtcagtgattcagtaaacaatattgagcatccattatgtgccaagcactgtgttaaattctggaaacacagagatggattagacccctgtccccagggagcataaagactagcagagttagacctccctcccatatgaagaaattaaatgaggtaaggcattaaaagtgctatgattacataatacagaacccaaaggggaaggcattttctgaaaaacagaaaactgaaaataccagcttttcagcctcacacagacataggaaaaccaacccccatcaacatcatctcttcttttttttttattattactatagtttaagttctagggtacatgtgcacaacgtgcaggtttgttacatatgtatacatgtgccatgttggtgtgctgcacccattaactcgtcatttacattaggtatatctcctaatgctatccctcctccctcccctcaccccaaaacagtccctggtgtgtgatgttctccttcctgtgtccatgtgttctcattgttcaattcccacttatgagtgagaacatgcaatgtttggttttctgtccttgtgatagtttgctgagaatgatggtttccagcttcatccatgtccctacaaaggatatgaattcatccttttttatggctgcatagtattccatggtgtatatgtgccacattttcttaatccagtctatcattgatggacatttgggttggttccaaatctttgctattgtgaacagtgccgcaataaacatacgtgtgcatgtgtcttcatagcagcatgatttataatcctttgggtatatacccagtaatgggatggctgggtcaaatggtatttctagttctagatccttgaggaattgccacactgtcttccacaatggttgaactagtttacagtcccaccaacagtgtaaaagtgctatttctccacatcctctctggcatctgttgtttcctgacttttgaatgatagccattctaactggtgtgagatggtacctcattgtggttttgatttgcatttctctgaacatcatctcttaatataaaaagcataatgtgctgatttcacattgcatgcctgtatcaaaacatctcatatgctctataaatatatacgcttaatgtgtacctacaaaaattataagaattttttttaaagcaacaataaatatcttcattagtcaaccaaattaaatctattaatatatccatgtttgtgaacaggatggccacagaaccctgtggatgcttaccacttaaacatttcctgaaacaaatatgtttccaaaacatcttgcctgtctaatctgacaactgcagacatcctaactaggctctgaaggtgctctccatagcactgatgttattgattcagttgttaacagcgcaggcataaatgactgatgataactctctaaacgtcccttcctactgccgttgaaatggctctgggctttatccaagcagggctgctaaatgaatagtagatgtaccagcagaggagaaattggtcctgaggtgaattaactctcctgaggtagatttgtttgtgcttccaacaacctgtacgttaaaccttgtgaaccttcatgtaggaattttgaggagaaatgggcaatttttggaaagcctaatgttttatcagccgctttttcttctcattgagacctgtgtattctcaagggactttggaagtttgccattttaagaacagacttgatgagaattatttgaagtcctccacgtttccatttatcagttttcctaatacagacatcctacgcacatcgttgaaagaatgttctttttgcctcacaggtagatcacaaaagtgggcccataatcattgggtagagggtttctcagctctgagttaaattgcagctgggtattgtttttctgtaataggatcttctctgagtgaatggtgaaacatgcccatttttgaggtcatgagagcagagctttccacatcatggacagaaaagggcaaccggccatggtttcagttatacagggagaggaaacaataggttttgtctctgctttgctattgcttcaacagcagcatactgttggacactcagacattagggcacaatttagacttgtttcacagctgtcatttctttcctcaaaaacaacaaacctgcatgggggaaatgagtctacatttcagggtttttcaagaattgataacataacatgtacttcaccatgaatttatattccacaggtccctgttctcttctctggtcatcagagtacaaaatcacaaccaaaaagcaagaattgatatctatgaagctaaagtagtagtagtagtagtagtagtagtagtagtagtagtagtagtagtagtagtgaagcaggatattaccctgatcccctcgcgggcgggaactggactgcatagccgcttcggtgctggcaggggcagactccactggctcagtctcactgagttccacccctcatgggagaggaagcacaggtgagtgggtacaggagccagggtgagtgcttttgggcgccagcaggaacaaaactctgtgtgggccccatggcagtgtctaggagggtgcccgcgacccttgaatccccagaaggagtgttacagggcccttttatctttgccatctgcagatggcttaagtgttaacagctcagtggagggtcagtgtgacagccttctgtactcgcacttgtggcacctcagatcttgcccattttccaggaggaatgaggtcacacaaactaattggagatggtaaatgcgggggattttattgctgatgaaagtggctctcagcaggaaaaggagctgaaaaggggacagagcaggaaggtaatcttcacctcgagtccagctgtccgcaatcagactcctctctgaagctatgctgccaggctgtccctcggaagtcaagccacttctctccaatgcacaaccatagtttccaacatccagctgcttctcctctgtgccggctgagcctgggatttttacaggcacaggatggagggcagggtgggctatgggtggttttggaaaaggcaacatttgagcaggaaaacagggatgtaagttctcactttgggccacagttccaggcttttaggcttaagggtggggcccttgccagagacccgccctcttctgtccagaatttccctgcctcctgtccctatcagtagtaatagtagtagtagtagcagcagcaacagaagtaatactaactactacataccaagcattatctacgtacttcatatctattcaccaacctaattgttacaactttcactcgcgtccgtgtgaagagaccaccaaacagtctttgtgtgagcaataaagctttgtaatcacctgggcgcaggcgagctgagtccgaaaagagtcagcgaagggagataggggtagggccgttctataagatttgggtaggttaaggaaaattacagtcaaaggggggttgtcctctggtgggcaggagtggggatcacaaggtgctcagtgggggagcttttgagccaggaagagccaggagaaggaatttcacaaggtaatgtcatcagttaaggcaaggaccggccattttcacttcttttgtggtggaatgtcatcagttaaggcaggaacaggccatttaaatttcacttcttttgtgatttttcagttacttcaggccatctggatgtatatgtgtaggtcacaggggatatgatggcttagcttgggctcagaggcctgacattcctgtcttcttatattaataagaaaaataaaacaaaatagtgttgaagtgttggggcggcgaaaattttcggggtggtgtggagagataatgggtgatgtttctcagggctgcttcgaggtggatcaggggtggcgtgggaacctagagtgggagggattaagctgaaggaagattttgtggtaaggggtgatattgtggggttgttagaagaaacatttgtcatgtagaattattggtgatggcctggatacggttttgtatgaattgaaaaactaaacggaataagagaaggagaaaaacaggtattaaaggacgaagaattgggaggacctaggacgtctaattagagagtgcctaaggaggttcagcatagccttgccagcaaagattatttactttaagagttaagagtggtggtttggggatagcaccaagagatatcagctgtgatggcttggagaaacagtgtaaaccagcagtgtaaacaagagcagggcatttatgactagttgagactggtgaataggagtatgactagacagaagataggagggatgacaagttttttggggtgcagtctaagttggtctggtgtctggaatgagactggggcctaataaaaaggagcgtccatacaggagcttaaatgggctgtaccttgtagcattctgaggacaggcctgaattctgagaagggcaagtggtaaaagtattgtccagtcctttttaagttggtggctgagcttggtgaggtgtgtttttaaaagaccattagttcactgaatactaagagcctgagaaactgcttgggtgatttgactaataaagtccagtctgttataggaccgtatagaggtgggaaggccaaaccgaggaattatgtttccctgtgggaaaggcctctacctatccagtgaaagtgtctacctagaccaagaggtattttagtttcttgactcggggcatgtttagtaaagccaatttgccagtcctgggcgggggcaaatcctcgaacttgatgtgtggggaagggagggggcctgaataatccctgaggagtagtagaatagcagatggaacactgagaagttatttctttgaggatagatttccacgatggaaaggaaatgagaagttctaagaggcaggctagtggcttgtactatagcatagcctgcctttgctggtgtgtggccattaggcctggtggaactgccatcaataaaccaagtgtgatcagggtgaggaacaggaaagaaggaaatatggggaaatggggttgaatgtctggtggatcagagatacagtcatgggggtcaggcgtggtatcaggaataatgtgggaggccggattgaagtctgggccaggaacaatggtaattgtgggagactcaacaaagagtgagtacagctgaaggagccggggagcagaaagcatatgcgtcaggtgtgaggaagaaaatagattttggaagttatgagaactgtagagagtgagttgagcatagtttgtgattttgagggcctctaaaagtattagggtggtggcggctgccgcacgcagacatgagggctaggcaaaacagtaaggtcaagttgtttggataaaaaggctacaggacgtgatcccagtccttatgtaagaatcctgactgcacagccctgcacttcagcggtgtgtaatgaaaagggttgggatgagtcagggagagctcgggtgggagcagtctctaaagctgtcttcaaggaatggaaagaggagtggggaaaggatttaggatctatggggtcagctaggtttccttttgtgagtttatataatggttttgttaggatggcaaaaccaggtatctaaagtcgaaagtatctaaccatgcctaggaggaaaaaacttgttgttttctagaagggattggggtttgggagattagtcagacatgatcagcagggagagcacgtgtgtttttatgagaattatgccgagataggtaacaggtgaggaagaaatttgggcttgactgaagtaatgggggctgtctgtgaagccttgaggcagtacagcccaggtaatttgctgagcctgatgggtgtcagggtcagtccaagtgaaagtgaagagaggctggggtgaagggtgcaaaggaatagtgaagaaagcatgtttgagatccagaacagaataatgggttgtggagggaggtattgaggacaggagagtatatgggtttggcaccacagggttgataggcaaaacaatttggttgataaggtgcagatcctgaactaacctgtaaaccttgtctgcttttaggacaggtaaaatgggggaattgtaaggggagtttataggctttaaaaggccatgctgtagcaggcgagtgataacagactgtaatccttttaaagcgtgctgtgggatgggatgttggcattgagcggagtaagggtgattaggttttaatgggatggtaaggggtgcatgattggtcgctaaggagggagtagaggtgtcttatgcttgtgggttaaggtggggagatacaaggggagatgtgaaggaggctttgaactgggggaaaaggcggcaatgaggtgtggctctagcctaggaatagtcagggaagcagatcatttagttaaagtgtctcggcctaatagggaactgggcaggtggggataactaaaaaggagtgcttaaaagagtatcgtctaagttggcaccagagtttgggagttttaagaggtttagaagcctggccgtcaatacctacaacagttatggaggtaagggaaacaggcccttgaaaagaaggtaatgtggagtgggtagcctccgtattgattaagaaggggacggacttaccctccactgtgagagttacctgaagatcggcatctgtgatggtctagggggcttctgaggcaatcgggcagcgtcagtcttcagccactaaaccgagaagatctgggaaggagtcagagagccttgggccagagttccaggggctctgggagtggctgccaggtgagttgaacagtccgattttcagtggggtcctccacagatgggacatggcttaggaggaatcccgggctgcgggcattccttggcccagtggccagatttctggcacttgtagcaagctcctgggggaggccattctggaggaacccctcgcagctgcagttcaggcatttggagttcttctgtgctggagatatggctggggtttgtctcacagtggagggaaggaattgcaactcagaaatacattgctacttggctgcctctactttattattgtacaccttgaaggcgaggttaattaagtcttgtggggtttgagggctggaatttaatttttggagtttaatgtcgggagcagattgggtaataaaatatatattgagaataagacggccttttgaccttttagggtctagggctgtaaagcatctcagggttgttgccaaacgagccatgaactgggcttgtttttttatttgatgaaaaagagcctaaacgctatctgatttgggataaagaaaaaggagcattaaccttgactatgcctttagctccagccacctttttaagaggaaattgctgggcaggtgggggagggctagtcatggaaggaaactgtaagccggaccgggtgtgaggagcggaggtgataaaaggattatagggtggaggagcagaggctgaggaataattgggcctggcgaggaggggagaggtcagatgggtctgtagaaaaggaagattagaaagactgagcgatgcttggggttgggactgaggggacaggtgggagggaaagaaggaagatttggaaggagttgcattgggaacagagactggggaggggcagatgtgtaaaagaatgcctggacatcaggcacctcagaccgtttgcctattttatgacaagaattatttagagcttgtaggatggaaaaattgaaagtgccgttttctggctatttggaactactgtcaagtttgtactggggtcaagtggcatcgcagaagaaaataaggcatttaggttttaggtcaggtgtgagttgaagaggttttaagttcttgagagcacaggctaagggagaaaaaggaggaatggagggtggaaggttgcccatagtgaaggaggcaagcccagagaaaagggagtagagacacggagagaaggggtggggggttcttgtcccccagaaaagcggagaaggggtagagacatggagagaagggttggggggttcttgcccccgagaaaagcggtacttgccgctaaaggtgaaggaccaaggcaggcgtccccgtgtggtcagacacctctgaaatgtgggtgaataatcaggcaggcatccccgcgtgattaaataccaagggaagactcttccgagtccgtgaccggtgccggagttttgggtccacggataaaacgcatctcctgtctctaccagaaaaggaaaggaactgaagttaagagaagggagagattgaagtggggcgccaagattgaaaggagaaagaggttgagggatagtgagaggttggaggagagagtaaaaagaggccgcttacctgatttaaaattggtgtgatgttccttgggctggttagtctgaggaccagaggtcgtaggtggatctttctcacagagcaaggagcaggaggacaggggatagatctcccaagggaggtcccctgatccgagtgatggcaccaaatttcatgcgcgtccgtgtgaagagaccaccaaacaggctttgtgtgagcaataaaactttttaatcacctggatgcaggcgggctgagtccaaaaagagtcagcaaagggagacaggggtggggccgttttataagatttgggtaggtaaaggaaaattacagtcaaatggggggtggttttctggcgggcaggagtgggagtcacaaggtgctcagtggggaagctttttgagccaggatgagccagggaaaggaatttcacaaggtaatgtcatcagttaaggcaaggaccggccattttcacttcttttgtggtggaatgtcatcagttaaggcaggaacaggccattttcacttcttttgtgatttttcagttacttcaggccttctggatgtatacgtgcaggtcacaggggatatgatggcttagcttgggctcagaggcctgacaacaacgatcttgtagataggtactgttgtaattcccagtttacaaataagaagactaaggtatagagagattgagtaatttgcccaaagcccacagctagtaagaagccaagattcaaacccaggtaatatggctgcagacctggtaatcctaaccattacattaggctgactctcgatagttaacttatttaagctagtgttaatcacatcttaacaagtttgagtaataaaatcttaggttgaaaggggccttcaagatctagtctaaatcctttcaggagttcttccacatttctgctagaaaacactttggcctaggcttaaaacttagtgatggggaactcctcactttgtaaagcagcctgttcagttcacaaacaccctaataattaggctgttatctcttgcattgagctgaagttgatcttcccataacctctgcctttctgtctatatgtatgctttggaaatatacacagtaagtgtaaaccctcttggcaaagacagcccttcaaatacttgggaggcattcaattccccccgccacctcccgctctactctcactaccaagtctttagaatagagtacaggtatcaaaatcaaaacaaacagggagtagaaacttagtgccagactttaagtattttttacttataaaatctttttgtgtaacgagtagagcaactcctaactgcatatatgtactaagtttgcaaatggggcaatttgtttttccccatgcactggcatcagaggtggtaaatgctggcctgtcagattcaatgcattttgctgggttagaaccgcaagggctttccaggggaccaagctctctctgctgtaatcattaaaacctgcagaatcctgtgtgactctggggagaagcccagtgctcttggccctcatccaccctcactaggaaagctgcttaaaactaggacagaagaaacaaccactggcttaggatcagtcctcagacctgccttggcactaccccttttattccaaattttgcagtggcacctccaacttcttggtcacgttttgtaccttgtctgtttcctcatataacttcattccaaattccaacccatgctctgacatttcctctccattcttgctagacaggaatttctggatattggatattggcccctgcccataccctgactctgtatattcttttgtcctgctgaccagtttgagcttctgaataacaaaaactccccaaccactttaaagtcctctactttagcttgatgggtccctctcctgtattttctgaccttgactctgctctctgtacaaatagtaattacactcacccccaagcagagaatctgtgtcaaaatccatcaggatatctaagcacatcattatatctgtcaacttccccagactcctgatctcaatcccttattttcaacaacctggcaccgacagagtataatttcttttgtatcatgatgcagtttgatgtgcttttcgaaaggttatggtggtgattttaaagagatctgttttgttagaggaaggaaggaaaatagtgctgtttgcttccatgcagttcctcagagcctatgccagggtgatttcagctcatgagagaatctaaagtctaaagagatgtgtggagattagaaacattggtgtaaaaaatcagattacggagacgtaatatccagggtgtcagaggaggcagggagcttcaatcatgtttgaaactataggtcccacccaacaggatgagaaaatacaggagaagccagaaaaggtacctgcttgtgggtaaaatcaattaaatggaatcaatggtatggtagccatcatttctttcttttcaaattgtggtaaaaacacataatgtaaaatttaccattttaaccattttttagagtatagttcagtaatgttaagtatattcatgttgtcatgtagtggacttgcagaactttttcaccttgcaaatctgaaactgtacccattaaaccacttctcatttcctcctttcccccagcccctggcagccatctttctactttccgtctctatgcatttgactattctaggaacatcatgtaagcggaattatacagtatttgttcctttttggactggcttatttcacgtagcataatgtcctcaagtatcacctattagctgtcattgcttgaacacggttttctgccaagcacatgatctcgttttattcccagcacaactctcaataacaactgtgtaccttttttccctttcacagattaggaataaaaggctctccaagactaggctcagaagcagaagcagttggagagttgcttgcagaaggattattgtcatactgggaagtgctctcaggatttacacctctaagaaactgaaaggggcatgactgcgcagaggaaaagctggttcaccatgcagttgcaattatggctgcagcaggagcatgcagggaagctctggagtaggtttggcctttcagagttgtccccagtaaatcaaatgggtgaagactttaacccatttatgctggaggttgcaaaaatgttttgtgaaaagtcagaccttggcgatgaccttgagcagtaggatataaaaaactcccacaagcttagcgtcccaataatggaacactaggcataaatgagttaatccctgcatcagccagtcattggccctaggtctctccctgagggaggggatgtagctgtgtgaggcagttccctgagggcacattccaatgaaggccccagctgtgagccagcagccaataaggcagcaggtggcccatgcatgcaaaggccctaaagaggaggtccagggtggagcgccacggtgtctactacagatgctgaaagagtaaatacattttatttatttatttatttattttattatactttaagttttagggtacatgtgcacaatgtgcaggttagttacatgtgtatacatgtgccatgctggtgtgctgcacccattaactcgtcatttagcattaggtatatctcctaatgctatccctcccccctccccccaccccacaacagtccccagagtgtgatgttccccttcctgtgtccatgtgttctcattgttcaattcccacctatgagtgagaacatgcggtgtttggtcttttgtccatgtgatagtttactgagaatgatgatttccaatttcatccatgtccctacaaaggacatgaactcatcattttttatggctgcatagtattccatggtgcgtatgtgccacattttcttaatccagcctatcattgttggacatttgggttggttccaagtctttgctgttgtgaatagtgccacaataaacgtacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgaccgccattctaactggtgtgagatggtatctcattgtggttttgatttgcatttctctgatggccagtgatggtgagcattttttcatgtgtcttttggctgcataaatgtcttcttttgagaagtgtctgttcatgtccttcgcccactttttgatggggttgtttgtttttttcttgtacatttgtttgagttcattgtagattctggatattagccctttgtcagatgagcaggttgcgaaaatttttctcccattttgtaggttgcctgttcactctgatggtagtttcttttgctgtgcagaagctctttagtttaattagatcccatttgtcaattttggcttttgttgccattgcttttggtgttgtagacatgaagtccttgcccatgcctatgtcctgaatggtaatgcctaggttttcttctagagtttttgtggttttaggtctaacatttaagtctttaatccatcttgaattaattttcgtataaggtgtaaggaagggatccagtttcagctttctacatatggctagccagttttcccagcaccatttattaaatagggaatcctttccccattgcttgtttttctcaggtttgtcaaagatcagatggttgtagatatgcggcattatttctgagggctctgttctgttccattgatctatgtctctgttttggtaccagtaccatgctgttttgcttcctgtagccttgtagtatagtttgaagtcaggtagcgtgatgcctccagctttgttcttttggcttaggattgacttggcgatgcgggctcttttttggttccatatgaactttaaagtagttttttccaattctgtgaagaaagtcattggtagcttgatggggatggcattgaatctataaatttccttgggcagtatggccattttcacgatattgattcttcctacccatgagcatggaatgttcttccatttctttgtatcctcttttatttccttgagcagtggtttgtagttctccttgaagaggtccttcacatcccttgtaagttggattcctaggtattttattctctttgaagcaattgtgaatgggagttcactcatgatttggctctctgtctgttattggtgtataagaatgcttgtgatttttgcacattgcttttgtatcctgagactttgctgaagttgcttatcagcttaaggagatttggggttgagacgatggggttttctagatatacaatcatgtcatctgcaaacagggacaatttgacttcctcttttcctaattgaataccctttatttccttctcctgcctgattgccctggccagaacttccaacactatgttgaataggagtggtaagagagggcatccctgtcttgtgccagttttcagagggaatgcttccagtttttgcccattcagtatgatattggctgtgggtttgtcatagatagctcttattattttgagatatgtcccatcaatacctaatttattgagagtttttagcatgaagggttgttgaattttgtcaaaggccttttgtaaatacattttttaaggtcacacaaatgacatatgggacagaacagtgtttaacttcaaaactcatgttctttctgctatactgggccttctctccgaaagaggcctaatttgcacactacagtcaagcttagaatctattcatagttaaaatgtggagtcaaagcccaggaactatgtccttcaattcatctttcattacttacctattccttatcattcccgctgacaccaaccattttttctgacccttgtcatgaggagtgaagttgtatcattgcagcagctttctacttgtactctatgcctaaaatctctccttcctccatctggtcagccaattgctgtcaagttaatcttgcaagaacactacttttgccagtttaatttcgcaaaactcctgctgtgtgccaggagtgtcccagacatcaggtagtctaagataagcgatagtctctgcccctaagccgtttgcaacctttggagagacaacgtcattatcaccaccagcacccccattaagctcagagctaatatatgccagatgagactctgccagtcactgtgctaaggacttgacatacgttatctcccttaattctaacaactactttctgaggtacctctgatgagtagtatcatttttagatacaaaagcagaaacttagcgagttaagtgctttgcccagtggctctcagttgagaaacgaggtagtcacaccaggcagtccaacttcagtacctgagttcttaatcatcatgtttacaactttggctcaacattgtcaccaagatcgggttcaaatacatccattatcaatattctttctgtctccttgtatgtccaaacaaacaaaacaaatgcttccctcctgatgaggaaagtctccaaatcttgatacctgctgtgtctggacagtttttcctgctatttgctgagtgctggaaggattccctcaatccagatgtgattgcagatccagctcaagctcagcgtcctccagggaacctttgaactaaccacccagaaacgagcctttcaccggacactactcattttcacatatctagatcttatttccccatctgaactgtaagtgtcttaagagctgattttgttgttttttaataaaaaataattcttagttttttttcttattaccaaaaaattattcgccattgaagccttctgaatttttaataagaaaactattggtatattgcttcaaaaagaaatctaagcttctagattcttgaaaagggatagtgacagaaccttagaattaatattcaatataactaatctgatgaaaattcagtcattgatacattactgagaactactagatctcagcatttttaattgtagattcacatggagttgtaagaaattatacacggactccacatacctttttaccgagtttcctctaatggtacacctgcaaaactctagttcaatgtcacaaccaggattttgacgtcaatattgtcagtatacagaacattttcatcactacaaagatccctcctattggccttttatagccacacccacttccctgccccccctacctcctacttccagcaactactagtctgttttccatttctttaattttgttatttcaataatgttatatgaatggaaccatacagtatgtaatattttgggatggacttgactcactcaacataattccctagagatttctctttttatatgcagcaagacttgtttcctttttatcgtgagttgtatgctatggtttggatataccctagtttatttaatcactcaccccttgaagacatctgagttatctgtagttttggactattgtgaataaagctaccaacattaatgtacaggtttttgtgtgaacataagtttttatttccctgagataaatgctgaagagtgcaattgttaggtcatatggtagttgaatgtttagttttaaaactgccaaacttttccgaagcgtctgtactattttatattccaccagcaatgtatgagtgatccagtttctctgcatcttcaccaacatttggtgttgtcattattttttatttttagccattctgatatgtgtgtaggaatatctcattgtgcttttaatttacgtttccctcgtggcaaatgctgttgaacaacttttcctgtacttgtttgccatatgtatatcctcctcattgaaatgtctgttcatgtcttttgtctattttctaattcaaaagtttttttatagttcggttttgagagttctttctgtatcagatactagtcctttcttgtgtatagggttttcaaatgttttctctctcatcttttcatcttcttaacaggggatgaaaaagaattttaattttggcgaggttgaatttatcgctttttccttttatggatcatgcttttgtgttgagtctaagaatactttgcctagccctggatcccaaagattttctcctgttcttttttttttttttttttgagacggagcctcgctctgtcgcccagcttggagtgcagtggcccgatcttggctcactgcaagttccgcctcccgggttcacgccattctcctgcctcagcctcccgagtagctgggactacaggcctccaccaccacacccagctaattttttgtatttttagtagagacggggtttcaccattttggctctcctgttttatatgtcttatagttttacattttatgtttaagtctgtgatccatttgatttttatataaagtatgaggtttaagttgaggtttattttttgcatatggatgttcaattgctctagcataattatttgaaatggctggcttgattattgaagtaaggtcagacttatttctctcctgggcttcagacccagccaccttctatgtttcttgtccaccacaacctgaatgtcccacagacacctcagacttaacatgtccccagcagctcattattatcctccttttgtcccaatccaccctcaacatttttccctccctaattgtgctgttcttatgaacgctacgcttcacccaattgcccaagtcaaaaattagggtattatttctgaatctacttttatctttaaatctaacatgatgcattgccaaattctgtcagctctatccccaagccatctcttaattcattcccttatttacacctcccttgactccaatatcttttgactcaaatgctacatagcctctaatttatctccctgatattgttcttgcttccgaatcccttttccacaatgcgcctatagtaatcctcctaaaatgcagatctgattaggtgactctccttattttaaagtctttcttattgttttctcctgccctaaggcagaagttccaacaaatcttgttatcagattctggattaaatcccggcctcagcagtgggacctaagatagtgcctgaatttccatgaacatttattgatgacaaagagggtcttaaataatgagtgatgtagactttccactgtcaacatcacagattctggtttttaatggtattcacatttgccttctccaagagtccaggtttaatgatggtgagacctatcctaagacctggctttgtagtgaggggttacctcatcacagaatcaagaagggacctcgggccgggcatggtggctcatgcctgtaataccagtactttgggaggttgaggtgggcagatcacctgaggtcaggagttccagaccagcctggccaacatggtgaaaccctgtctctactaaaaatacaaaaattagctgggcttggtggcacacacctgtaatcccagctacttgggaggctgagacaggagaatctcttgaacccgggaggcagaggctgcactgagccgagattgcaccactgcactccagcctgggcgacagagcaagactctgtctcaaaaaaaaaagggcggggggacctgggtgcaagtaattctaagaagcaggaataagagaacaagaagaatgaagcgacaaagaaagatgagcaattctctggaactgttgagaagtgtacagaagaaaacaaatctggatataggtagctacagcctgaaatatggaaagccagagcatgtgtatacctgctcctgctcccactggttgagaattgattcctttttcatctgatatgggcaagcattggatctgagtgggacacatcctctccagtgcacccctgccttttccgctgctctgaacttcacacaacgtcggaaagattcaaaacaatgtagaaaatctaagtataaatacaaaaaggaaacaagaagtttttctatcaaagctgtgaactatatgatatgagtaagctcaataaacactgtgcagaagttgggaggggaaaaagagaattgctgccaaagcactaacccctgtggctggctatgcttgcccacccaggaagctcccatgtcatgggggtcaggggaacctagaacagaaagctgaaaggctcagggatcccttttgagaagggatgctggctatacagcacgagttagaacttgcacagaaccgtccactactgctgacactggaatcacaggtgggctgacaagatgtgatgcaagcaccagacatatttgctacaaacctcaaagtggagcagagcagcggcagtgtcagtcttcttggtgtcaatagaatacctgtttatttgttgaattctccctatatgaataataataatacaagaattcaaagcaggataggctttgtgtcattggaggagtatggagaaccatcagtgcagtaagtgtcgtgggaggtttctagacagtttttaaaagtcgatattgagtcaaccatcaaatgtgaacaattctgatatgccagagcatttgtattcttaactcatggggttattacaaagatcaaatgaaataatcattataaagcactttgtgcagtgcctggcacaaagcacgcactcaatacatgttaatgtttatacaattattattattgattgtcagaattatcagccccacatcagcaaagaatagtaggtggtctgtcagcaggaacatggaaacattctcattacatagaagtcagtgttgcagggacagtcattaaaacaggatctaattttagtcttctgagggaaaatgctaggttctccggaaatgttgaatccttcctcgagcatgtagtttaatttttcaaaattatattgcatatcctgtaaaatgaaaatgaaattgtactgctgttcattaaaggcccccaaaaatcttaggcactatacaatataaatgaaaaaaaaggcgttatttttccatagggcataattagaaataaagaagcaaggtcactcacaaatttccgagctataaaggaggaaaggaacaagattttcccccggttattttatagctgccaggttgaactcatacttatccaatgagccccagaatggaataccgttctacaccaactgtactgatgatagtgattcagggagtaaatgataagattccatccttctaaagtgcttttgggattggattctagtaagtttcattttgctattggccaatcacaaaagagactacaatagagaaaagtgaagacatcatgctgaagacagactgctgcatagaaaaggaagagggaccccctaatttagagatatggatggagaaaaaaaggcacttatgctgtagcataagggaaacattaaataaagctataatagaggagaaaatgtctttgaatagaagaaaaaaatcagacagacagaaatagactaaaatgctaaaaaaaaagatacaaaaggacattgaaggggacatacagtgattattacacaaattaaatgcacacagttaaaagggaggtgaaaagcttctaaaaagaatgagtgtgtagtgaacttaattttatcatctttactaagacaaagttaaagtccctaaaatattttaagacacttaaaaaaaaaagtcttaaaattttgagagcctttcagctctgtcaactctagactttccctcctacttaagttttttttcttttttttcttttatcttttttatttatttatttttttttttatgttttttttttttttttttttttttttgagagagagagagagtggatcagccttaataagagaatggtcttctgccaggtggtattctcctaatccctttccagtgagatccacaagggttcaaaaccactttctggggtcttagaggcaccacttatctctcttcctctgctcatatctttctgctccagtgcccgcatagtttgtgttatcagtggtgcgtagcctgagacatccacgacctatgccagctctcgaagtaatgtgattggcatccaaagaaacacaagaagcccatgatttcgtccctttgcaatttaaaatcatatttaaaatgccttttggtcatacaaatttgaaaatgatcttgtaaatcacttccgggaatctatggtcaaaactcagcttagagttctctacttcttaacagagtgcctgccggtaactagtgactgtcaatgagtttgaaaacataaattgatgtgcaaatgctagataatagcaacatcctgtgcaactgggcagcatttctgttgtttggcttttttattttcgtggactctcccaatctgagagaaaatagatttgagttcctttttaatcggtttagacccagacaaggatttaattggtttagaccccattcacctacgtgtgtcactctgtctccaacataacagaggagatgaccaagacaacatgctctccagccaggaggtggggaatactttggtgtcatagcagacaattattgatggaaaactcatgttagaaaatgtaaggtaccttcttctagacggagtaaaaggggcagctgcccagactttcattttaaatagggagcccatgatacaaatcttttaatacaattttaaaaagaagagacatagggggtatctcttaggacctgtcaacaaccaaccctctatcaaatggccaaatcacaggtggtctgcagcttagccaaaatgtccaagtacctttttgtaacacagaatctcctttgaagatccagctttcattaatgatccccagcagctctggtcaatgtgtcttttcacaaatgaagctttttaaaagctttcagtggacaaatgtggctttgagttttcaactaaatctttctgtttaaaaggagtgctgaaatgggcatactttataatcttaaatgctgcacacaaaatactgaaatattattgaccctgagaggttggttcaaatcaaatagcatactcacgtaaacgttctcttttcctaatattagcaacagggaatgtgaaatagagaggggcgggatatgctggataggggtgcaccaaaattttcaaaaagcctcgaaactagtgtatattgataaccttgtggcatctaatatctagtattctttttttttttttttttttgagatggggtctcgctctgtcgcccaggctggagtgcagtggtgtgatctcggctcactgcaacctccacctcccgggttcaagtgattctcctgcctcagcctcctgagtagctgggattacaggcgcccgccaccacgcctggctaattttttgtatttttagtacagacggggtttcaccgttagccaggatggcctcgatctcctaatctcgtgatctgcccgcctcggcctcccaaagtgctgggattacatgcgtgagccaccgcacccagcctagtattctatgtctattatttcttcataatgagactgggggaaatctttggagaattaatgccgcagttggtaaaatcattctataataatgggtaccattctgctctgtcccacatttttatgaagtctctttaaatttaaaaaggcaatgtgctttgtggttcttgagcaacttaaatacgttgctctgaatagttattgtgatgaggtaatttgtaacaacttttaggatcaatgctaattttcttaaatgtttctgtagtttcccctttattataaagtatattaggctggactcttggctgtaagtgacagaaaactcaactcagattagttaagaaacaaaagggtgttggtgacagtggtggctttcagactattgctgcaggcccacctgccatcctcttaacaccctcaacataccctgcagaaaagagagagctactctgacccgagagcttaaagactggtcaagtatgggcttgactctttatggcccaaattgggtcacatgcccacctaggctaggggaatggaatcgtggaattgattgattgattattgttgcaggttgagtcctccaagaagcagatgccagggcagatttattgcagaataacacctgtgaagaaataggggtggaagcagaattgaacaagggaagccatcagatcacaatgcagatcttctagactctgtgtcagcacaacaaggaatgccagagcaaagactgccaattagaggaatactgaattgggcagatctgacaatagtctgtatataactcgggactgttaacttctccttcctcaaccagttatagacatagaataggactctcttatctcaaacatcaatatctgtgtatatgaagtagagggtgaaagtttactgtacactagtggttctcaaccaagagcaagtctgtcccccaggggacatggcaatttctggagacattttcagttgtcccaactggtgaggaggtgctactggcatctagtgggtagaagttgtggatgctgctaggcattctctataattcgtgggatagatagcacaacaaaaaattgcccaggccaaaatgtcaataatgctgaagttgagaaaccttgctctataaagatacatgtcttggccgggcacggtggctcacgcctgtaatcccagtactttgggaggccgaggtgggcggatcacgagatcaggagatcaagaccatcctgggcaacatggtgaaactcatctctactaaaaatacaaaaattagccaggcgtggtggtgcatgcctgtagtcccagctactggggaggccgaggcaggagaatcgcttgaacccgggaagcggaagttgcagtgagccgagatggcgccactgcactccagcctggtgacagagcaagactctgtctcaaaaaaaaaaaaaaaaaaaaaaaaaaagatacatgtcttatgtgtactgaaagaggccacggaaaccttttgttgatacattcttgatagtttttgttcttatatgtagttatgaatacttgagattccatccaatttatttaacttttgaccagaaagggtagattgaattggtgaaacatctatatcctgaatatttaaaagattctgttttttaaaacaaatattaacttgaattaacgtaaatattcttagtagttaaagtccttaaagaccttagtttggtgaacagataagaatcatctgtgttcagcatatgcattgccttatgaagatggtaagtcaaaagtatgagtttatttctgatatttaaatatccctgaggtatagatttgtttactctggaagtttactctgttgtttgtttgtttgtttttgtttttgttttttgagacggtgtctcactctgtcacccaggctggagtgcagtggcacgatctcggctcactgcaagctccgcctccggggttcacgccattctcctgcctcaacctcccgagcagctgggactacaggtgcccgccaccatgcccggctaatttaatttttttgtgtttttactagagacggggtttcaccgtgttagccaggatggtctcgatctcctgacctcgtgatccaccagcctcggcctcccgaagtgctgggattacaggcctgagccaccgcacccggccttactctgttgttttatttcttcattatatattacaaagttgaatgttagggccaggttagatcggaaaacaagttaagtattccttatccaaaatgcttgggaccagaagtgttttggattttttatttttgtggattttggaatatttgcatattcctcatgagatatcttgggatgggacccaagcctaaacatgaaattcatttatatttcgtatataccttatacacataccctgaaggaaattttatacaatattttaaatacttttgtgcgtgaaacacaaaagttttgactgtgacctgtcacatgaggtcaggtgtgaaattttccacttgtgacgtcatgtcagtactcaaaaagtttcaaaatttggagcatttccgattactttggaaaagtctagaaaaagtttgatatcagtgcactgaaatcattttcaagtaggaacaatagcgatactagccctttactcatgcaaaattcacagtttttatctaaacaacacaaaatcattcaatgcttttatatttaatcatctatattcacctaaccataaaaaatcaatttcaatacagtaaggaaaagacaagaaaacgaatcattctaatcactgtattttgaaagttctttgcaaacaaccgtgaaatggttaaaagataggaggatggagaccagcctggccaacagggtgaaaccccatctcttctaaaaaatacaaaaattagccgggtgggttggcgcatgcctgtaatcccgggtactcgggaggctgaggcaggagaattgcttgaacctgggaggcaggggttgcaatgagctgagatcatgccactgcactccagactgggcaacagagcaggacgtctcaaaaaaaaaaaaaaaaaaaagatggtaagagaatgatgacttgttgcttactaaaataaaggaaagattgacactataagtgatactgtttgaaatctcaggaatctctgaatcattaagattatatcacaaatggcatgcaaaatacctgttcaaaaaatactcctcatggacatgagatgctaagctgctgatactgagtctgacctaggacaatgatgttctgtgtcacctcttttctgatgcctcccagattgctcctggcctcactgctgtctcacttccaaaaatacatattgcccttattggtcataacacagagactatcagttcaaaagtctctaattcgtctcagctgcagtcatctcccagcaagacacaaggttcttgagaaaagaaatttttcatgtcccatctttgccatccaccacacgatgaacatacagtacagtgtacatagcagcccttgaaaatgctggtggaatcattgattcttgaacccaactgtcatactttccagatttaagtcctggtaaatgattaaaatcgtatgggttaccctcaacaaaccagctcaagtatttactataaaaaagggaagctagatatggaacttcccctaaagatgggtctgtcaaactcaccccattgtattctgctctgacaccatgttttttgtttgtgttatttttttttaagagacagggtctcactatgttgcccaggctggtcttgaactcctgggttcaagtgatcctcccacttcagcctcccaggtcactgtgagagattacaggcttgcaccaccatgcccagccccaccttttaatacaaataagtaacagttaccatttactcagtgctcaccttataacagatgctgttaaacgctttacacgccttagctcatttttagttaaatacattgtttttgccccagctatggtagggatcttgctaacaatgagaatgaatgataagaggggctttaaggagaattcactgccacacctttcataattttcccatcattcctccagtctttgttcaaccgtccatgatttactgatttgctattacatcaaactatgctgcaacaaaccagtggttccttctgatttttatccatctcctcctcacctagggtgagagtctgaggcttccttgagtctactttctgatattgttacatttaacacagaacatctcttgttttcgtttctggcagcttatcctctcttcgctttctccatgctttcattcatcctaaaacaccattctgacaatgatatttaggttggtacataagtaattgtggttttaccattaccttcaatggcaaaaactgcgatcacatttgcaccaacgtaatatttttcttacttaaaaaattaatgtagagtatggaaatacttgccatcagggaatggggaagaaaatggctagagagacatggtgaaagagagacttgatttttaaataactttttttgtttttcttgaattttattatcatgtgaatgcatttgaaagaaatacaattttaaaataattattaaaaaaatatttgaatgccttcccatgaacaactaaatgaagtctctattcttaaacctgacagtcaagtacagctctggtttgactccaagctacatttctagccttgtattattcaactctttttctgtttatccttcatatccgggcctttactagtgccaaaaaaaaaaaaattgctcattctactcttgtcacccagagtgtttcttctgtttttgcccatcaaaagcttacccaattgtgaaggcccagtttcaaagcaacctccttcattaatttcatccagatactctgtaacccccatagctgtttaggcttgttctagcaatttgcagttatcagaaaaatgagtacataccgagtgccagaaagtggtctctccaactgtgcacattacaacatctcattctctgtgcctccatttcctcatctgtaaaatggtcactatggtgtactttcctcatagtgatgttcattctttcaagtagttagttaggtacctactatgagacaggcactgacctgggtcctgggggtacagtaatgaataaaatagattgagtcctgccctcatcaaatttaccttctgataagaaagacataaatgaaatatacctataatgctcttgaaatagcacttgggatatagtaaatgctctataaatgtttgctattattactgtcattgttggtagtgttgttatgtggtatttctattaacacataaagaaactaaggttcacaggctgttagataagatgctggttaaatagctagtaagggactccaactcaggtcttcctgagtcataaaattcgtggcatttccactacactgatggatgtataccaggctgtacatcagaactatctgtggagacttaaagaaagtaaagattctcaagcctcagcctcaaattaactaaatcagaaattatttagacgagctaagaatctgtatttttttgaaaagttctcaaatagttgtgatacactgtcaaattggggaatgactgcactacattaaaatctttcccataatactttattatgcttatttgtaaatatcaaatctacaaattcactaaagaccatccccttgttttcttatttatttttattttttctgcttcctctcctagcaaagtgccttataaacactcaataagtatttgagtaattaatggcttaattatttaaagttgcacttaaaatgcaaatactcacagctgtggtactggaagcctgttatgaacaatcatttatcttcctagggttatttactaatcagctaaggacaagcagttgggaaagaaaggctgactatttgggaacagaactgagaaggccctcaaaccaaatgttagccacgttattgaacagcctagggccccgccttaactttacctacacttcgttgacaatttcaggtaaaatgcagaaaatatacgctaacaatcaggagattcctccctcacaccattgtagtttcatttcttttaagccgacacatgtctctcttatggaaaatatgggaacaacctgttttaaagaaagaaaaagaatcctttattcttgtcacaccacaaacatggagttcactgctatacgttaagattataaagcaaaatcccaaaaacgcagtgactgattattcacagtagacatatgaagtcaggaagcttattttttctctctttgctaaggcacaaagcctggggctatatgcatttttattacactgtactgtgttgatttcacttgaggattaaaaagagagttgaggcacagtgcacgtatcttgatggattttaggatttcttgctttcgtgaaagaaagaagcttataaagtacctcagattatcgcccagggaagtgtacctacttccatgatgacctagaaattcaatcttttgtttctcctataaaagatcacattgtactttggatgttttccctgtagttttctgcactatgtaaagccacatttggaaaaacaaaatagttttagtttagagttgaagtgaaaatatctgaaatagttcaggaaagtcttatgagcatttggggagcttacaaacagccttgggggtggggtgagggggaatgagggaagagggaggcagggggagagaagaggagggctaggtcagaagtgtgcaaagaagacagagggagagagaccgtagagactgtgagtccatggcagagttttaattctggttctcacacatctacacagagaaacaatggaagcacattgctccatcccctgtcctttactaagaagcgtgaagtaaataacttgtggcttatgatatgcgaagaagagagaagacagaatgttgtaggatttggaagtacagtagatgagatcttccggtttattgatttgtaaagaacggcttgatactggtttgtcagttctgcatcagtgagagaaaagaaaggcgcttttcagtcacttgccagaggaggagagccgggaagtggaaacagggtcttctggcggacaagcttccttgagtggtggtcaaattgactgtgaagggagtcaaggtcaggaagctttggaaatgctgcaaggatggtacgggatttaaggagggttgatttcctcggttaagggttgttgcagacttcagcaaattcccccttccagcctttattaaagaagtgtttagtagaacaaactgaaaatctacaagtatattgttacccaaaatataaaagcttctgccactgagatgaaaatgtttgatttccagtgctttatctttttgcatttatctacctgtttcagtcattcgttaatatgaatttcctaatatatgccgtcttttttttttttttcggacaataccagttctatggtatctcactgatgattatttcaaattgccacttttgttccttggaaatactcctgtgttcaaataccaggaggcataattatgtaattaccatgtgaacattatgctacttatgggccaaaatgcccctagaaaggaatgctccaatggcctcagaaaatttctgtgagaacgatatcttccaaatgtggtataaataaagctcaagaataaatagctaaggctggaatgtaaatgatttaatgtaatgatgttgtaaggtgagagccacttgactttagttcctgttgcaaatcatgagatacattaggaaaacttttaaaagggaacctattttttaagataaaatctgtatcaagttacatcaccttccaggcaaagtaattcaactttcctcttttctctctgagaccaaaaaaaaaaaaaaaaaaaaaggcagaagaaatgcttcctatgatctcttctcttcctgtcacaattttcataagtctgtagatgtaattaaaactaaagattttgacaaatgaaacaggataggaggttgattgctgcttttctaaattaaaatgaatgatacccttaaggtacttgggtctatgaagtcaatttaatgttgatataacctgactccattatcacagaatgaggcagttgcataagcaagaaaaccaataaacaaacatccaaagtgcattttagaaatcggtgaggtgaaagattaaaggcttaacaacggacaaagagcttgctgttttgttctctcttgccttccagtttgatggcagagttcatcagaattagaggaagaatgttcttggagaagcgttgggctggcactaggctaggagtcctattcatatcctgcctcgcttgtcttgcaagcatgcacagccccttcatttgaggcactgtttgcctcagcagagtctgtgtactcttctggtaggttgtatagaacataataaagggggagggctggaggagaaaggacagaaaaaggagggaataaaaaaaggagtcagattaagaaagaagtcagcacagaaatataaaatggaaggaaaaaaagctgtgatgcaggaaccttaaaaggtagattaaggatggtctcagatggcacggcattagtatcaatgccataagtcacacaaaatctattaagaattatgctcctactcagagtgagtgccatgttagcactagttgtttcccgtgatctatcctgaagtcaaacgcaagaaacactgtttaactcctaagtgccctaatgtcaggaaaacacagaaataaactcaaaggaaagacaattcagttaatctttgcattcaacaagcccaggttgttttgccgcagagctatacctatcacaaaacttcattccagaagatggccggtagaggtggctcatgcctgtaatcccagcactctgggaggcccaggagagtttgaaatcaagaccagaacttatctcagactttttttttttttattattttttcagttacaactcaaaagaatcagaattagaataataatggattttaactgaaagggattaccattagttaaaaggattttaactgaaactgtaatcagtctcaggagcgtttcccggataatgtttgggcacgtatttatgagtgttacttgtgaggatttgggagtaagaatgaacgaggaagttcctcccccaacacagacacatgcacacagaaactgtacaaactgaaaaacttcaggacaaaaactcgtgaatagactggagagtcatttgtgtgcatatgtgtggtttatttactagcatcacagcacaagagtttctgtcttttgcttttgtttttgttttaataggctcatttgtgtaagtgtcatgtctgtttcttgcattcccatggatatttatctagggtctagacaaactgagaaccagaaaatcaaaacatacgttcctagttacatattttctctagactggagtaaacatgatttatgtatgtagtaatcagtaagatgtagcttggacactaggaagaaaccacattgcctagcagtgtatttccacatggggaggtaatgcctgtctctcctaaacttctagtgaagataaaactcaaagtagagtaattaacagaaaggtcaaaagacaaagtggaagcccttgagaatctaaaacaaagttaaagaaccaacatttacatttagataaatttatttgaaataatttctaagagccatgatgttgttatcggtcctttttctttctttcttttattcttttggcttatttaaaagcaatgttgaagaaaaaatgaaataaagcttatctttcacaatacacagaggaatggactgagctttgggaaacagtcacagcttggaattaagagtgtgtgtcgtatcgtaatttagttggatgatttggtgctcattcattatacccagaattacgctttcaagtctaccgtattcatacttatctcagtgcctgacaaataagaggaactcaaaaagcctttcattcattcatccattcagtatttcttgatcatcttctatgtactaggcattgtgataaattcttaacaagacagataagatctctgtctttgtggacaataaacttacattctagtcaatatcttttgaatgaatgtagtgatatttcttactgaagctaagaaaggaaggtctctgcaaacagtatactgtctacagaactcatctgaaatgagaagaccaaggagaataatatatagccctcataactctcaaatcttaaatatgattatttaaaaactagagtaaaacaaatgtggaggagatttggacttcagggttgttttataaattgccgttttacatttttaaatctagtattataggcaaaattgaatctaaatggttttcttcttttcttttttttactttcatcatcaaaaatggaagaaaggaagaaaaggaggaaggaagaaaagaaggaaaggaagaagggagggagggaagtttttcaaaagcttgtgtcagggatcttgaaaaagaaatgattcattcaaaatatagttgttaatagtaaagatccgtgaataaacagtacattaattcattcaactaatattaatttagcacctattatatgccaggtactgtgctactcactgaggatttagcagggaaagatgtgtccctgtcctcatggaacatataaaaaaggacctttttttcctgagatgcttttactgaagaattgctgcaacctagattatgagttctcatggaccagatggcagttttctgcccatctgggatagttctgaagaatagaccctcgtgtatcaatcaaggtttcttccagttctaagctttcgtgatctatgatctaatagttgaaacaggatgtatgcttccaaaaagatgttatatttgtattacttttataaaaggaaacagagacatgccctattaattcagaagagattgggttcctcctggctgtttaaatcattctatttaaactcctttatctcttctttcttggctcaccttccaaagctcactcttaccccttttagtctcacttccctttcctttctttaattgctgagacaaattgttcatctctaactggctatacatgacatctccagttaaatgtttcactgttaggacaaattcattatgttccaaatgaattcatacatacatatgctatttcttccttttctgattttcatattgccaccagcaatatcttcattctcccagtcttccttactcgaaatccaagagtttatttgcttcttcagatattaatctccaacaccaaattggatagttcttcctcctttcaaaataccttctcatatgtaccttcttttacattgaatacaatacagccttaattctaatgcatatcaacccaagtctagtaagttacaacagcctctttctgatctcagtctcaggtgccctttcgaatctgttttacactatactgatcttcccaaaccctaactttcctctaaaatagtgagtcatgtcacagaaattttcagtggttctctttgcctgcagggtaaatcttgagcctcagagtctgggacgccttgctttgcatcatcggctttcaacatgactaactaattgtatctcactgtcgtcctcaacaccactgttctgcagccccaagcctttcttcagcttgtcactacttcttacctccaaacctttacacttgcagagatcagggactatagcatttgttttttgcctatctctttcaatattaacaaatacttataaaatgaataaaccaccaaggaaagaactgattgtgccagaacataagacacaggtatatcatttctggcttttgcttcctgttttgtatataccacggtatattgatttaacatacagccagttagaaagatctaatgcatggaggctctcgtttaatagattatcaaatttcatttccttgcataattgctcaaagaataaagtgctttgttcctaagtcccaagctaaagctttcgaggactttggttgctttcaagtttttctcattcataaatttgtttctttatttagccagttgtgcattcaatccacacaaaacctttctccagtgataatttgtggaaagaaatattttatgcttaattcttctcgctgtcataccttctcttaagtttgagttatgaagatggaaattcactttgatctcattttaaaatcttgacaatattgaatgtacactggaaactaccactggagcgctccttgtataagaaggcaaaattcttcagagagaagattgggagtctagaatgaactttgatgctgcatcggctcagtccctatgaaactaacattcttactagagaaagtggcctatggcacagtcataatcctttaccatctacatcttccccttgggatttctttctcagtatgtgcaaagatttctgatcagtgtccactcccatatggcatcttcatcttctcctctctacccccaaacactcacatttatctctagattgatttattcatgaaatgacccattctaaatttagaaataatgacatatgcccaacatttatttgcacgcgttttcccacaacctttctctataatcttatggtatcacattcttcaagaccaggaattgaccttgcattgggccataaaatacgttgaacaactgcagtttcatcgatatgcacactagaattggtctgcattcaataaactgattaaagaaattaaaaagccaattacttattaaatatttataaaatactttttttcaactttaatcttcaggatagcagttaagagcaagacccagactgaatgagtttgaatcctagctctgccaatttactaactactgaagcttaggcaagttttttttttttaacctctcatgcctcagtttttatgtcaatgaagtcggggggaataatattaactcctattgcagagttactgtgaagatgaaataacataattcatattgtcatgccacatattgcttaataaacattagccatttttgtattgtatgtggtgccctgcacattatagtctattgctctccttttttgctttttttttttttttttttgagatggagtcttgttctgttacctaggctggagtgtagtgacacgatctcggcgcactgcaacctccacctctcagattcaagtgattctcctgtctcagcttcccgagtagctgggattacagatgcccaccaccacaccaagctaatttttgtatttttagtagagactgcgtttcatcatgttggccagaccggtctcgaactcctgacctcaagtgatccgcctgcctcggcctcccaaagtgctgggattacaggtgtgagtcaccatgcctggcctattcctctccttttattaaccataatagtagcaagaacagtagctggtaacatttattgagcaattaccacgtgacagaaactaggctaaatgctttacattgtatcatcttatttaattcccacaaaaccctataagttatattattttccacattttactgataaggaaagttaagaataatttacccagggacattgattagtcaaggttctccagagaaatagaagcaacaatatacatatgtatgtatgtatgtatatgtgtgtgtgtgtgtgtgtgtatatatgtatgtctatgtgtgtgtgaatatataaaattaagtattatctcatgcagttggagactaagaagtcccatgacctgctatctgcaagctagagagccaggaaaattggtagtgtgatttcagtcccagtctgaaggcctgagaaccaggggagttgatgatgtaaatcccagtgcaagtgcaggagaagactgacatcccagctcaagcaggcctgcagggaaaaaaggaacatgcctttttgttctgtttaggacctcaactgacaggatgatgcccgcccacattggggagggcaatctactgaatccactgaaccaaatgctaatcttgtctgcaaaacaccctcacagacacacccagaaatagtggtttacctgggcaccccatagtccagtcaacttgacacatagaattaaccattacagacctgcagtcagtgcactcagtgtcagtaggcatacttgtttgttccgcatcgcttctcttctcttctctctctctctctctctctctctctcacacacacacacacacacacacacacacacacacacacacgtaccacatttactcatttactcatccatttgtttggtcaactagtcattaaacaaatatttgctaccatatactatgtgcctcctgcagaaagggttggagacattcgaagagaaaggtaaacaaaaaatggtccctgctatcaagaagtttccaatctattgcaagacacactcatgtccatataactaaaatgaattatatgatagaagtgcttcaggtataaaccatatactgttagaatgctgaggaagccattaattctaacctgggagatgaggaagtaaacatataaacactaacagcattgatctgggagagaagtggggtaagagcattgccgagagaaggagcagcatgaagaagccacgcacaagagttatattggatggaatagtgcaggacaggcaggtagttttggtgggcttagcaggtagagtttgggagtgcagggtcataaggttgggaaggtaggtttgatatgtccctcatgcttttgtgtatataaaataaagtaaatcctgcattgtaggggaaccccacttggttatccacgtatttgggccaagcaaaaatgggcaagtctagggagagagtgaaaaaatgagattgttctggatatacactaggcacttaattgatattggaaggccagagttggtttgagaccaggctacctgagccacttttctgatgagattaacatcgatttttacctctcgggaattctgcacaccacgggaactaccccctgagttctgattgctctgtgcaagctctgatcaacccctagtttagcatggactgttcacaactaaatcaaaatccagagttagagagctaggatgcctggagccaccacttatattggattggcaaaatgccaaataagtaagtatagcatgtcacccgtaaaattattcctttcttccccaccaagaatagaactcactaagttgacagcacactgtgtcaatatattatagaaaaacctaataggaagaaaagaatggcagttttcactgcatgccccctaaaggtatatttcttaataatttccaagtccactgaaaactgaattccgaaaattagttttatcttactacccaccctattttatcccaaatttaagccttgcctgtacttctttgatacttaatatttttttctttgaggtggagtttcactctgtcacccaggctggagtacagtggcgtgatctctgctcactgcagcctccctcctgcctcagcctccctaggagctgggactacaggcatgcgccaccacacctgactaatttttgtatttctagtagagacgggttttcaccatgttggccaggctggcctcgaacttatgacctcaagtgatccagccaacttggcctcccaaagtgctgggattacaggcatgagtcactgtgcccagcccataattaaatattaatcaaccactggttaattaataattatcaataattaaatatcactcaatgatttattatctattaatcaatattgcttctttaaaaatttgtcaaaaacaatagcctaagacttaaagacaagacatgtcatttctgagattctgtagtcacctataccaaatgtcaccctccctaatgtttttgtgaaagtaaagatttgtatttttttatggtactaattgaagcagtagttcatttgtggctgccaatgagttgactgtaaaaaaaaaccaaaatctcattttaacattgtcgagagaggaaatcctttgtgtttggccttggattgataaaaacgagtctggaatactatatacggtaagtgaatattaaaactagagttatgaaatgttgctttagtgttctcagtcttggagactcaaagtatcttatcagaaaggatacattgttttaattgttcctcattatatagaatgagagaacatcatttctctccttttcctcccaggtggccgtcgaggaccgagtcaggcagctgcatgaagcccacagggactttggtccagcatctcagcactttctttccagtaagtcattttcagcttttatcacttaactttattgcatcttgattaataagaataacagttgaaaaaacaaaagaattaagagttgaattatagtaatcttttatcagatgcagtagaagcataaatcatcctgaaatataacttggttgataagttgagaaggttaggaagaggaaggccaattggatcattttgtccagtcttcagctaatgcataattgtttcctgcactatattctcaaatgttaaccatattaatatttttgagtctttttgaaaaatgtggaacactttgctcaggagccatgctagtattctctgtatcattattccaatgttagtatatgggctgctgaagcaaaaacatacttttgagtttttaatttctgcctatcagttcagttcataaagctaataattatgatatcatgtaattataatatgatcatccaatatatgttactgtgactctataattctttaaataattcattaaatgatccctgccttatgaaatgagtgacaattctcaaaagaaggcatacaaatggccaacaggtatatgaaaaaatgctcaacatcactaatcaccagggaaatgcaaatcaagaccacatgatatatcgtcttaccccaattagaatggctattattcaaaagacaaaaaataacagattctggtgagaatgtgaagaaagggaactcttttacagtgttgatgaaaatgtaacagtaaattagtaacagtatgaagattctcaacaaactgtaaatagaactaccttaccatctggcaatcccactactggttatccatcccaaagctaagaaatcagtatatcaaaagggtacctgcacttgcatgcttatcacagcactgtttaaaacagcaaagatgtgaaatcaacctaagtgtatatcaacagatgaatggataaagaatatgtggtatctgtacacaatgaaacactgcaagaatgaaaccatgtcattcacagcaacatggatggaactggaggtcattatgttaagtgaaataaccctggcacagaaagacaaaaatcgcatgttcttactcttgtgggagctaaaaaaattgataataaacatagaatagaatgatagatactagtggctgggaaaggtgtgtgggtagagggggagataaagagagggtggttaatgggtacaaacatccagttagatagaaggactacgttatatcatttgacagcagaatagagtgactgtagttaacaacgatgtgttgtatatttcaaagtaccaagaagaaagggcttgaattgttcccaatacatagacaaatgacaaatactcaaagtaatggatgcctcaaataccctgacttgatcattatgcattctatgccagtaaaatatcacattacctcataaatatgtaaaatattatatatcaataataaataaatactatgcctccaagttgaaacctcagcctatgggcatttcctttccctaactgtttgcatccttcctttttttttttttttttttttttttttttttttttgagagggagcctcattctgtcacccaggctgtgagtgcagtggcgtgatcttggctcactgcaacctccgcctcccgggttcaaactattctcctgcctcagcctcccgagtagctgggactacaggtgtacaccaccaggcccagataatttttgtatttttttagtagagacgaggcttcaccacattggtcaggctggtctcgagctcctgacctcaagtgatccactcgccttggcctcccaaagtgctaggattacattcgtgagccttgtattctccttttgttcttgacctctagccattctttttatttactggttttgctattttattaattatgtttttataattaatactaagagaaataaccttggttaactgaaagtttaagtattagaaaatcctatttatacaatattgcatattaaattggcaagcacctgttttcctctgattaatgttaatttataccactttttatttgattataaaagtatatgtgttgagttttttggtatttaaaaagccatactttaccacatggagttaacatctgttagcattctgatgtatttccttgtggtcatatatgagtatatatgagggtttatccatcattttaacgcaattactttgtgcctagaaatgttacagattttaactagtttaatccttatagcaatcccttcaatcccttaaggtaggtaccattattatacccatttcaatgatgaagaaactgaggcacacattcatacagctagtagatgagggagccaggattgaaactcaagaagttggctccagagtctgtgtttttaagcatcgcactgtaattttacttaatttatatattttatagagaggaagtaattctgtatgatctccattcttctgccatattctttcattgccattttctgatcatttcctttcttttccattctccacgggttaataaaaagatccacgctcacaaatactttaaagtatttgagtagatgttgtcatgtgtgtctccagttggctgttgtctttttgaacaaaatttcctggaaggtgttggtcctgtgtttttgtcatacatcgataatagattaagaagaagtatcttattttctggactggctctaactttattatccgcatgtggtctagttatttggacacagtttcacaatgctttggagttgccaagaaaaagggataagttaaagcagtttatctaaatgagtgggatcgtggcttttaggaacggctctagaaaaatgataaaggctacagatttcgtcttctgcatctttccaaatctctggtctacttaacttgccttggtgacagccattctattcgatttaattgagattaaatgtgataacatactcctaagcgactcataaaccataaataaaaaatagtactattatgaatattaattactcctcagacaccaggtatattcattcatattttcttctccctgactccccctctgaattcccatgtcttacccattaaaacctattttcagaaaatgatatactcatttaacccaagtgataggtaaagtttaatgtgtacttctcctgggttatttgcattttattagtgtgaaaatccataagcctgaggtggtagaacatcggccataagctctgagctgtgaggaaggaactttgaggggccaaggggagcattctcacacctttcaaaccatatcacatcagtgcccacttccagaaaggtcaggcctgttagacacaggtattcataaagagactgatctacctgcctgaatggagccagccccggaagtcatcagtctcttggatgcccatgtggaatatcaatatacgcttaaaagctttgcttgcaggtataaagaaaataccaacttggtttaagggatatttaagaaataggacggtgagactaaggatggattgtttctttacattgtactttttaaaattacaaaggtactctatacacatcaagaaaaatttggaaagcccacagtacaaacaagaaaagaaaaagtatccataatcctatgactcagagataatcactatcagaaatttggtttatatactttctgtatttctcttgtggttgcgtgtgtgtgtgtgtgtgtgtatcaaggttctatcttttatttttttatttttttgttttttgagacagagtgcaatctcagctcactgcaacctcccccgtcctgggttctagcgattctcatgactcagcctcccgagtagctgggattacaggaatacgccaccacgcttggctaattttttgtatttttagtagagacggggtttcactatgttggccaggctggtctcgaacttgtggcctcaagtaatccacccactgaggcctcccaaagtgttgagattacaggcatgagccaccacgcccggcctctctcttttcttttaaaccatgcgcagataaaaacatgctacagttttatgagctgcttttttcccttaaaactatctttccaatattttcgtgtgtttaaatattcttcttcagagtaatttttctaatgactggctaatactctcttctgtggctgtaccaaatttaccaacacaattctaaattgctcaatataaagattatttcacaatctttattatatcgagcattatggctaatatcctttttatacctttacaaatatctcagattctttctacaggataaatgcctaaaggtggaattgtcatgttaaagaatgtttacattcgtaagccttttcaagtgtattgccaaacttacctctagaaaattgcaccagaaattgggtgtgccatccaaaccgtatttgagctaggcatggtgtggctcatgcctataatcccaattctttgggaaactgaggcaggaggatcacttgagcccaagaggtcaaggctgcagtgatccataatccacccccccccgcactccaatctgtgtgacagagcaagaccctgaccctaaatttaaaaaaaaaaaaaaaatcaccatatttgaagcaggacatctctgaagtcacgtatttgctactataaaagcagcttccccccaccaatgaataaaaatatgttttaaatattcctctaaggtcatattaaatgaatttgaattgatacttttttttagacaggcctgagttgatacatgtttagtaatgtgctttcaggttactataaataataatagggtggctcctaaagcttagaaattacaaagaaaagaaaaataaggaggaactactaattgcacccgccagcgtaaacatgcttactgtctctgtttatcttattctctctctctctctgtctcgcacgtgtgtgcactctctctctctctctctctcacacacacacacacacacacacacacacacacacactcccctttggaaattatttggaaattacattaccagctgtctgttgtttatcagaagacagaggcagccttttactaaaaaaaagaattcactgtttcttcctggtggcccaatctctacatgttaaagaaattttttcttttatcttagatctaagagaaaatgagaagagaaaagcattgtgaaatatgacccttctccgctgatagacactaacttgtccttacttctagttttaatacactgctactcctaattgacttctacaacttaaaccaagaaaaaggagaaattctaatagtgtgacttcaaatatgtatataatttacaataaaattatcatttaaattatttaaattatatactaatttatagttatatatgtataattggtaggtatattgtcagtctcttcatatgtctgtgattaagaaagtactaaagtattcattggttggcatagtagtctgaaaattgtccttttcttttgaagagtttaaagatttgttgggcgtggtggctcacacctgtaatcccatcactttgggaggctgaggtgggcagatcacttgaggtcaggagttcaagaccagcctggccaacctggtgaaacccccatctgtactaaaaatacaaaaattagctgggcgtggtggcactcgcctgtaatcccagctgcttaggaggctgaggcaggagaatggcttgaaccctggaggtggaggttgcagtgagctgagatcatgccactgcagtccagcctgggtgatagagagagactctgtctcaaaaaaagaatttaaagatttttcctgaccattatttcaattctctggtcttctgttctaaattctacttttctcaccaagaaagatcactatatatttgggtaaagggagaaatcattctataacagtaaaaagaatccatggttttcttaatattttacaagttccagaggtcccttaaaagaatattttccaagccaggttctttaaaacattaatgttatattaggttttgataactgtcccttgaaaaaaatagtactgattaataagattggaaaaacactaggtttcaaagataagcaagtttatttcttgttagaattcttggaatttttattatacactgagactctaagaggataaggagtctatagttctccagttttaggtgactgtggaagcctttttcaggcacaccagttaatttcacactaaactttatgccatggatcacagtgaatctttgccttaatgtggtatttgccagatgctttaatgacaaaaaatttctgctaaaggttgtagaaacgtgatccaattaaaaagaaaatgagtatttatgaggcaaaagggtcaagtccctctctttactgaagttcccagccccactcccacccaggagccctcttgtgctgtggagtttcctaactggagataagcttagaaagtatctataccagtagtttccaaactctgaggtgtggctcattagcaaatcctaaaatcagtttaatgacttacaaccaacaatttttgactggtatggaatggaatggaatggaacagattagaaaatatcagagtgcattacctaagcaaggttaagtgttgttttggcggtggttaatttgttagatatgtgtgtacatgcgtgtgtgtgtgtgtgtgtgtgtgtgtgtgcgcgcgcgcacgcacgcgcgcacgccagatcacagtgtaaaacgtttttcttctgtgggttgcagtcgaaatagtttgagaaacattgaatcattcgagccctttccttattttacagataatgaaataggtgcagaacgatcaaatgacataaccaaggtcacaaagatagttataatactgggactggaacccagtttctggacatccaagccacacatcacactgccttacccgttaagaagaaatgcccaggccaataactgtctagtctatctgctattgccaacgattattctctcgtatattcctcttcgtttggccatcctaagttgatttacataacctaaatttttctctcaacacctctgggctaaaaactgccttatcaaaatggtatcgatagcggttaagagtaaaagctgtaaaatgaaactgactgggttcaaatattgactcagacactttatgcttttttctttctctttattcttcatctttaaaatagggataatagtaacatatttggtcaattgtaagacacacttttccacccacgtttcaacagttctgaaatcagaatgcaccatacgaccaatgggatattgaattcggtgaaatatggctgtattatttcatagggttacagtgaagatcaaacagttaatatttgtaaaacccttagagtagtgcctggaacatagtaagtgctattcaagtgtttgctattagctttagcattagtatcattattactatcagcttgatagtataacttaatgcatgcctgttagagtcaaactagtcatgaaagtttcattcattctcttgcatttaatggtcagtataagtagttcctctcctttctgaagatgatttccaaggatctaatctgaaagtccagtgttttgcacattagaacggctcaatagttgtttgtataactaacgagtgataaataatcaaaaagatagaccttaatctctaaaatgtcaggatagtattagtcttgttgacagttatattctacagtacctaatgtggtatgtggtacttggtagatgttcagtaaatatttacagaatgaattatgtcttatacccaaaagaagaagaggtaaattcactcttgacattgataatacacagaggcatgagatttagcatagtggctatcacatagtagacactcaataaataatgtgaccttttctgttgcttctcagcaaagactaatagcattcataactttatatggtcgtttttatcaaagtcgactgtaccatgtaatacattaagggaaaaggctgacttcaaaattacagcatgatcacaactatattacaaaataaaataaaaataacagaaatgtacacataaaggaaaaatggaaaataaaaagataccaaaagacaaacagttattgcatcatttctttctttttacttttacaaattttctggtaatagcatgtactacctttgtaatggaaaaaaaacaataaaggtaacattttatactccagcttttaaccagtgacctcttgcagtggcaatgggactctgaaagacaaatttcctttttactatttattctgaatttaaaagctgtttcattgagtgaccttctcagattatgagacactgtaaaaagaaataactgatccattatttcttgcaggctttacaatcttaactgccttaatcatatccctggttaagtctttttctctcttgtcaaagtgactcaagcttttacagtttctccttgatacatagggcctagcagtttgtttctatcttgagagttgccaagctttcatcctggacattccccactacacatacacacttaattttaaaaaataggggaaacctttaagcacatctaataattgctgacatttcacttaacagtgctccaacctatgctaccagtgtcctcaggggacagacaatttgaaatatgagtggggcaataatttaaagcttcagattggcttaaataagccatcatgaggccgggtgcggtggctcacgccagtaatcccagcactttgggaggccgaggcgggcagatcacctgaggtcaggagttcaagaccagcctgaccaacatggagaaaccctgtctctactaaaaatacaaaattagctgggcgtggtggcatgcatctgtaatcccagctactcgagaggctgaggcaggagaatcacttgaacccaggaggcagaggttgcagtgagccgagattgcgccattgcactccagcctgggcaacaagagtgaaactgcatctcaaaaaaataaaaacatcaaaataagccatcatgataaaagtcagaaagaattttgcaggtccaatgtgagatgatttgcaggctaaaattctctttcaagtaaaatctcagggtgaaatgatttgagccagtttcttcagcagtcacatgttgtcccaagtgttaggaatttgggacaaatgccatgtgacctaccagtgatgctgataatgcccctataaattcaaagacagcctttccaatgcccataaaaagcagctacagcagtaataattatattctcttcttaaaatgtgttgtcatggcccttttctcctttagctcaaatgtatactccccaataagctctcagatttatttgctttacagtatcattagcaaccagattttgcatcgttggccctatatatcccatcaatttgaacacatgaggaaacagaacgtttttgtttctgctatgggaatttctgtgctggggctggcttacaatggctcaagagagccaattgtaaaatatacaggaattgtgagctagttattaagcctacctttggtagcttgaaatcaggcatagtgggaagatttactccatggaaattggcaaatactacaaattggggcactttgttttttttttttttttttttttgtgcatagatggtttcccagaaatgactaatttatctatgttatttggatcactcaagtccctgtaggcaaagaatcttcataaacttagcaggaaggatgctcaggatccaaatatttatgtgcgttgcagagtgaccactcatcctggtttgtctgggactttcccggatttagcactggaattcccattttccaggaaatctctgtagtcccaggcaaaccaagatagttgctcaccctagccttaggtaaaatccctagaagtagagccctatttagatagatggggcttcttgtagaagtaatttgttcaggtgaaagggagtgagggaagcaggataaagtaagaaggatgctggtcaaggagttaagtgggaaggaagagactcacttcagcttgatcccacagggagctctggagaacaaattgtccctactttgagataaggggcctgggctttttgtttgtttgttttgagatggagtcttgttctgtcacccaaactggagtgcaatggcgtgatcttggctcactgcaacctccgcctcccaggttcaagctattctcctgcctcagcctcccgagtagctgggactaccgcgcctggatttttttttttttttttttttttgtatttttactagagacggggtttcactaggttggccaggctggtctcgaactcctgatctcctgatccgcctgcctcggtctccaaaagtgctgggattacaggcgtgagccaccgcgcccagccagggctgggcttttattttcccgtgtgaattagtcattggctgtggatttctggggagtaggagatagcaaagcagttcccatttggccaagggaggatttctggtgaaaggaccaatgaggccttagcaaccaacactcacaacaactgcggctgggtgaaccagctcagtaaaagggatctgagtggaacaacaatagtattaacctctcctagactttatgaagctgctatcataccccatgcataatctggctttagagctgaatgggcgcatttagctggatcactaaccaccactccttcgtcacggacttacatggaaattagcccggtggcatggaagagatgagacaaatgtctgtttctttcttatttcatcttcctcattgtgacagattcttctgggcctcatgaggagctagggccaagagaccagcaccagagttctgaatcagttttataacatgggcactattttggtggaatgctggctctgaagggtgtatttttacactacccagaaaatgaaggcatttgtgaatttggcctggggtagcattttgtcatctgtccaaaatacaaagctttgcacaacagaaatagtgggatcacatccctgtgggcaagaatcattactttcgtttttccatttggatgttttccattttcagaacacaaccagtttgggattacaaagtactttctggtgagaactttgaagtgaggacaaaaggcattttgttctttagtagacttacataaactgttcctggtttaaaaaccattctagatttttaaatagactttcagatatctgcagtaaaaatcatcttgatttcaggcgactgcaggtactgctctgttatgtgctatgtctccttaaggctgtaagggacagggataggcttaggtgataaggaacattttcaggatacagagaggcatgaagaataacatgggccgggcgcggtggctcacacctataatcccagcactttgggaggctgaggcgggcggatcacgaggtcaggagttggagaccaacctggccaacatggtgaaaccctgtctctactaaagacacaaaaaattagccaggcatggtggcgcacacctgtaatcccagctactcaggaggctgaggcaggagaatcgcttgaacccaggagacggaggttgcagtgagccaagatcacaccattgcacaccagcctaggcaacagggcgagactccatctcaaaaaaaaaaaaaaagaaagaaagaaaagaataacatggaacaacagacaccacgaaacatgtttgcttctttctgtatatgcatttgctgccatagacttcagactattacagtatcatatcttctctcttctctccacctaacaccttctacttatagtttctactttcttatgacttccattttcttcctttgttatccgactttttaaacttccccacccatctgtcatctctgtttatctctgtgtattacattcaagctctccaagacaaagcatctgattggattagttatttattatccatctaagggtaatgccatctcacaggccacaggccagactgtaaactaggctttcttgacctgggcactattggcatttggggccagataattagtggaatgctggctctgaaaagtgtatttttacactactcagaaaatgaaggcatttgtgagtttggcctggggtagcattttgtcatctgtcctagaatacaaagctttgcgcaacagaaatggtgggatcacacctctgtgggcaaaaattattgggggctgtcctgtgcattatctctggcctctactcactacatgccagtagcactcccctcccttagctgtgacaaccaaaaatgtctccagacattgtctgtctgatgtcccctgttgggtgaaattgcccctagttgagaatcactcctttataccaatgcctgcacaatttgtggtaatgaaagtcatgtggaacactaaatacagtgacctatgcctgaggaattatttgaagttgcttttctgcatccttagggaccctttagtctctcgatgaaagggagtgtcctcagcagacaatcttcaggaattgcatcagctgcctcacccaagatcataccccttacaggggcagctcttcctgatcagtgtaggggaataatgacctggccattttggcccaactcaggagaacattaacattctagctcaagagctcccatggggttgaatgagactgtcactgggtctgcattcaccttgacttctccctatttctattcctgtttctttcacttcccttccacagttgtctatcctgctctctaatcattgccttagagttggcttcctggaggaagccaatctgtgagggggcaatgaaattgacaggcatttagaagcatctaagaaaaaggtattataataggcccattacagtcactgggtaatttgatttactcttgctttcataatgaggttgattattttgttcaggataagtagtgattattattatttaaggtgtccaacctcatgatctccattaataggtaaggactttggggacagcataaaattacatgaatctcttaccttaaaccttaagctcagcagcatacatgcccatgacaggcaagagttagaacgtaagatggtcagtaacatagatcttgaaaggaaatatgttggagtgtgagcactttaagggcatagggcctgcattacttttttattaaaaataattttgcatctaacacaacatcttgcatattagatgcaggatatgccttgattgaatgaataactgggcacttaaaagattgttcccagtctaataaaatgaaagaacttagcctggtgcttagtctaatgtccagaaagagttaatgaacttcactttatcttcagtcagttaagaattgattcactttgttactcaacaaatgtctgttgaatgaccaatgtaaatcaaactctgatctaggaactggggaaacggcagtaaataaaacaaagtttatttattgtggagcttacattttaacaagagaagatggacaatcaggtcatgataagtttgatttaaaaacaaagaataaagcaggctaaaggggctagaggatgggagaaggggacccttttagtggagtggtcaggaatggtgacatttcagtagagatgtgaggaagtacaccagtcagatattgggggacaaagtgttccaggtggaggaaacagtaaaagtaaaggatccaagatggagcatgcttagagggtttgagaaatattaatagcaaggaagccagtatgactgaagccaaggaagaaagatggtgaatgataggaggtcagtgagtgaccaagggccagacgaggaagggtcttatcaactatggttggctatcgttaaaagcctttggcatatatgctttgtgagaagggaagtcatagaattctgagctaagaagtgacatggtgcctgtagcattgttacttactgtgcctgtagtattcattcattcattcctatatttattaacaaaaacgagtcacctgaaatatgaagataaaaagagaattattgccttgggacatttaaataccaatcacaaaagacagacctataaaaaatgacctcctacagtggtagtaaatagtgggtgcaatgggagtagaatggaagggaggaatccattccacagtgagagaaaggagatgttctatctagttgagtattaacgcatattgtccctgaggctacatgcaaatccaaagtagagggtattccttttgataggaacttagcaaagaatgtttataattgcttggtccctgatctcacctagcaagagtcacaagatgcattcagtgatgaaaaatcagtttctcccttctacttagccattctgataagatgaatatctcgggccgggcgcggtggctcacgcctgtgatcccagcactttgggaggccaaggtgggtggatcacctgaggtcaggagttcaagaccagcctgaccaacatggtgaaaccccgtctctactgaaaaatacaaaagttagctgggcatggtgacaggcacctgtaatcccagctacttgggaggctgaggcaggagaattgcttgaacccaggaggcggaggttgcagtgagccgagatcgcgccattgcgctccagcctgggtgacggagcaagactctgtatccaaaaaaaaaaaaaaagatgaatatctccctttccagtttcgtgtgtagtctccttaccgcccttctgttcagaaaagggatttcttacgtatgtataatgaatataaatataggttttagagagcactaatgttttaatgagatagaaataggcagacgagagagaataattgaaggattagtcaacatgagggcaatttgatagggaaagaaaaagtctgagcaggaaatgtctgtggaaaaaaaaaatcgaagaggaatggaatgaaatgagctcatttatggtgtgagttagggacagaagggatttattctcaggaggtgaaaagtgaaggagttcatgttatagaattcgacctagaccagctatcaagggaaagaaagtaattcaaaagacttggtccaggagatctggagcagatacatctattagaggaagattcagttttgaactgcatcttcagttattcctggaacccaacacaaaagctcatgacaaccttgttatcttcaggcaaaaaaaaaaaaaaaaaaaaaaaaaaggcgggggcagcaaggcttatgtcttaaacaagacagcacataacttcaggtcagagaattccattaacatgaatcacccacaccaatttaaataggaaaaaaaatagtaagcttggttatgtaaaaatttagtttaaaaatcagaaccaacaattgaaattaaacaagaatgttttatttatttctaaaaatatttagctatttattttgaattctgaagcaatactaatatagtatataatgataaaacacagttgattttcatagtaaacatcagcatcagaatgccaagaggaagatttgtctccgttcatgttttattactctgagaaccgcgtaacattttttaaagagtcagaaaatggctagaaaaagaggaagaaagattatttccttaactagttccctggtcccatgctttggtggttaacagtcagtttaactctagaaccatggaaagtctctgtcactttcctggttaccctgggattcctcacattggcagtaagttcgtgaatgagataaatatcctgataactagctacattaatgatgaaaataattataaacgtaggagttggaatttttaaaaagtatcgagcgctctgtgctcttaacacagaggaagcattttgcatagattaacccgtttaatcctcacaccaacctttaaaataaggactgttattgtctccatttcacagaagagaaaactgagactagaacaatttactaacatattcaagttcatacttgtaactattatggattatcagccttagaaaaggggttccagacaccagtgaatagcaacccacacgtctcaactgcacagaccaaagaggatgataatccccattaatctttgcatgttagtagaggcagtggctagtaacaaatgggagagactttggctggaggatattttttattctttaatctttatgatactgtttcccctctccccttctctctctactcctctctctgtcagctgtatccacaataatgccacaatataactactatacaagaatataaagcttctgttctcatgcttatgggtctacaggtcaactgtaattcgggtgatctggataaaacttgactggaaagctctacttcatactgaagcatgcctgggttcgcctctaggctgtgagttcagtttagatggtttctaaatgtgttgggttgtgagccccagactaaaggatcagaagcaacctggggcatgttctcatggcagattgccagtgtgacaagcctctgttcacatcatatctgctaaagcaagtcacatggtcaagcaagccaaggtcaaggagctaggaagcacactgcgctcaccatgaggccatggctaaggtatacatgtttagttctttcacaactgagtgaaaaatgggccccaaattcaatctctcctatactctttttgcgttaattgctagttctttctcactcttctcgctttctaatggatgtacatcccatctatgatcatttggtttttaatatctgagttgctccctactgtctcaggtttcaaattttactttccttgaaatttccctggtgcctaatacaatacctttcacacagagagcgttcagcaaatggtgtggactgcctgtcgtcttttaaaagtacatctgcagagacagtaaaggcacctggcgatattgcattgacttgttagtaacctgacttaacccagatggcccaaagactgtaaccaccattacctggaggaaagttccctggtaatgcagtcagccaattatgttcgaatttactcgaaaattccttgagcataaattattcatggctctatttatgtaggtatctatcttcctatatctgaccttaggaagcttgattgctttcttactcttctaataatcaccgtgatgtttttgaagttttctataagtcggttagaagcagcttttttttctttttttttttcatgagtaatgccgcccaactttggctattagactttgtgtgactgtgcagccatcagcactggatattagatatagttttatctctgcaactcagtcaccttgccaagaattttagtatgaactcttgacttcccagatcaaatgtgagcctgatactctaaatgacttggcaatctactgacaaatcccatggtgtggtattctgttcaccatgtgcaatggtctcagagctcagcattatctgtctgacagctcatataatatttacaggttgttattcgttaggaattttagttagccataaagattttcacagctatggcagacattagaggtctcattcatcactcttgtgaccttcctctctggaatgtagcccatctgtctctgctgttgaaatctttatggaaagtctgcccatctttgaaagtttagtaagtgatcttaaagttttcattgaatctttacttttgatatacgatatagacatataaagcactatccttattttaatttaacgttttgaaaagtgttaaatttaacttggcctttcatttaaatgacagaaaacttactcttgctacaggaactatatgcgtcacatcaaaagaaaatagaaatcatacagaaaaaaattggaatgggaaaaattacacatatatacatatatattcaacactaataactacatgaaagcttaaatactgtattataatcctgattatgactttaggaaatgaaaacgatagaaatacattttgcatataatttaacgttataaagaaaccctaagcaaattcagtaatgaagtgaactgaataggctgggttacagagcacaagagagggatgaccaacaatcagatgttgcccctttccatttctgttttcctctttttatacacaacttctcaaatgcttgcttcccctccgtctactccctccttcagcctctgatcactagtgtgaaattgcccttttgaggtcaccagtgatcgtgggatcaaatacatcttcttcttctacacccttagtctgtcaggctcaagaattgcttatacttcaccagctaggctgttcttgtgtttcatcccactttattctagcttctgtattatttttctttgacagcagttctactgccaccgccatttgggggcatttgccagggtacattcccttttgttttcctccactgtactcatctttttttttttttgtacttttatagctttcttggggtataattatatgcaaaaatatgcatatttaatatatgtaatttggtaagtttggacatatgtatacacccaagatactattgccacagtcaaactaaagataacgaacatattcattacctacaaaagttttgtgtccctttgcttttgtgtgtgtctgtgcatggcaagaacacaacatgagatggaccctcttttttttttttttttttttttttttttttgagatggaatcttgctctgtcgccaggctggagtgcagtggcacgatctcagctgactgcaacctccacctcccaggttcaagcgattctcctgcctcagcctcccgagtagctgggactataggtgcgcgccacctcgcccagctaatttttgtatttttagtagagatggggtttcaccacatcggccaggatggtctcgatctcttgacctcgtgatctgctcaccttggcctcccaaagtgctgggattacaggggtgagccaccgcgcccggccgaggtggaccctcttaatccccttaagttttaagtgcactacacagtattgttaactataggcactatgttgtacagcagatctctagaacttactcatcttgcataagtgaaactttatactcattgaataacaatttctcgtttcccctgccctgtcttctggcaaccacttttctatttactgcttctatgaggttgactatttcagacacttcataaaagtggagtcatacagcatttatccttctatgactggcttatttcactgagcatgtctgcaaggcccatccacattgtcaccaatggtaggaaccttcttttttttaatgctgaatggtattccattgtatgaaaatgtggtgtatacatgcagttctctttgtacgatcttccttccttaaagagtccagccattctcatagcatctgctatgattctagtacttatggtcttgtcctttcacttgcatttcagtgaaaagaaccaaacttatgctgatgcaaatacctgtacacaaatgttgataccagctttattcatgattgccaaatgctaatcagtctatgggcctctgattttcactgcataaaatatagactaatctgtttatcattcatgctgatgaatggtggataaatggtctagctaagaatgaaagatctgttgtatagatgtcattggtctaggaagacagagatgtagaaagaagtaccataagcccaggcagttagatactattcaaaggcatttctctctgccatactttatactacatgtggcacattaacagtagttaggagtggattcaaggctgcagataaatgctgcccaggtgagagagaaagaattggttccacaattaaccatcattcagacaacacatcatagctatgtgattacaaacattatttgtgtggtgattaacattttacaaagcaatttcatattgatttcctcattttatcctgacaacattttggtgagggagatatcattattcccattggaatataaggaaaataaggcttaggcaggaaaaagactagcttaagatcatgaagtgataggggagtcaggactcaaatccagttcttctgaatctgtactctggacattttctgctatatccagctccctctcaagatgctggattgggctttgaaatagaaagccaacatcctgagtgcctttctaaactctgagttttacagtctatcaggggaagaggagagtgtgagaggaatgttcccaaataatctactgtatcaagcagtatatctaacttgctttgagaattatgccaactaaatactattgacctgcagaaaattgatttttctctttacacttatatcaataaagagaggcttctgctgccataagtgtaatttatgtaaaatgtttttaaaacattcatagcctttaatcaagtaaatatacttctaggaattttgctttaaaaaagtaactaaaatatgtgcaaagatttatctacaaagatgttcactgtggccttacttagaacagtgaaaaactggagacaacttatatgttcccaaagagggaatttattcaataaatcatggtacatccataagtgggaattttttagcaatgaaaaatctgttgtaaccctacaagcccactcttaagcattcatcttagagaaatgaaaacttatgcttatgcaaacacctgtacacaaatgttgataccagctttattcatgattgccaaatgctaaaagcaacctaatgtctttgaacaggtgaatggataactaagctgtagtacacccatataatggcatactacttagcaatgaaaagaaacaaatcgttgatacagcaatatggattatgcattatgctgagtgaaataaaccagtatcaaaaggttacatactgtatttatatgacattctggaaaagacaaaacaagtctagtagatcctccctaatgccttttgttcaaccccagaggtgagttttctattttacctccagtgattgctgtatcggttatttatctaaactgtccccacttttttgacccacctatgttatcaaactccaaatccaccaagtatgagaaaagtagagagatgaatgaaggtatttgtgttggaattccagaaagtgctcttttggcatgtcttaaaataacattagcattctttttaattttctggttaggcccctatgttgattaaaatatgacttaacaccagggtgcatcacttggaacattctgttcatcatgcatttaaaaacggctgaaataacaacttcccctaaataatgtggcctgtgcttgtgattttcaaaactaccttgggcacaatattgaatcctgtcacctcaaggaaggaaaagcatttgaagatagaattgctaccctttcttgctcttaataacatactgtgtctgtaacacaaaaggaaattcagaggttggttttgcaataaataaatgcatgtgtagtttgctatctaaattcagtggacaataccccatgatgctggtgccgtatgataatggttgatttgtacattcaagaatctgaatcacaaagctgccctggaattacacgtagtggttataagcacatctgtataagaaaataccaaaggacaacccggtgtcatatagaaactatttgccgataaatttgcttttgatgggctactaaaaatggacacatcaggcataaaagatgtgtgtgtctattacgtaggctagctttatgaagaatgacaagcttccactggtacactgagataagaaacagctgttgttggcatcagtactgctacaagaaatgaaaaaattctgtggcacacttgtgagcactgccacatatttgatcaacttttgaatagatggaagaccagaatcatctggcagccccaaatgaaattgtcgacaacccttaagaatctcttgagaaggagcactgaacccaattccgtagaactatcatccaattgtgtgttatttctaaagcaagtagttccagtgtgtgtgtatgtgattatgatggggcagggaaggaatgaggggaggctgttgttattttcctttttttttttttttttattgtgtcaaggacatttttgagcataaaattgtaaggtttcaaacaatgactgcaaagcagttgcttaggtgaatttataaactgtgaatcaaaggggaaaaacatctttcagaaaaaaaatacactgaatctcaccattggacctatttgatggctacacataagacaaaaagcttttttaaggaaaataaatgaacacttaagaactgcaattacaaaagcttgaaatttcatattgatctagaatttataatatttttaaaattctttaaaaatattttcagctatttagttcaagcatattctgataacttctctgacatttaattgaaaattttccccttttaatgtaaacataaaaagtcaactctagataccctacgtaggtcttcccattagctcagccaggcaacgccaattttcctctgtctctcgctgcttagaggttgtttctttcaggccgaaagcccctaagccaggccaggcagccagcagccctctccagcacacttctttctgagagacgcctaagaatagtgtaggaaatccaaagtgattcttctgctatcagaggatggtctagcatcctccaaattagaaagaatttctggaccactagaatgataaaaaaaaaaaaaaactagaaaggtataataagagaaattgtgaggcctcagcccatagatacctttaaggaaagaatagccattcttttctcagtttaggtattcacaggcttggcattcacagccagtgagggctggaccaagagctctctggagttctcttcttccttttatgatgctggtattttaagaagaaggtacactgagcagccaggagctataatttctggctctccaccatgtttcctgctatagagggctagctttttaatatttccataacaacagactctgaccagataggtcaggaagtctagcccatggtttgtttgtttgtttgtttgtttttcagttggagttttgctcttgtcgcccaggctggagtgcagtggtgcgatttcagctcactgcatcctttgcctcctgggttcaagtgattttcctgcctcagtctcccgagtagctgggattacaggcacctgccaccatgcccggctttttttttttttttttttttggtatttttagtagagatagcgtttcctcatgttggccaggctggtcttgaactcctgaactcagatgatctgcctgcctcagcctcccaaagtgttgggattacaggcgtgagccaccacgcctggccttagcccatgtttttaaatcagatcttatttactctgtgaacttatttggacaggagagctgcatcctacagaagaaaaaaggacaagagaagagttgggaagagaatgagaaaggcaaagatggaaagggaagcagggaaggcaggaggaagggaaaagaaaggaatagagaaagaaggacagaaagaaatggaaagtcagagactacttcaaaacagcagctaaatgtcttttttctctgtattaaaaatttccgtctgccaaaatgaaaaagcataattaccggccaaatacaaatccatttcctatatcgtttaaatgacatatctccaaggtacaaaacagcatgtctggttaaaggttgggtgatttgatccctctattactctatataaaacaaagaagctggagtttcattacgcttaaattgtctggcagtgggtgaagttaacttttattagaagctgttctttcatattatacagtgtagtcgaggatatattagctttgacgttttcttacatctcaatacactgcggagtgaatttactgtgagactaatttaaaagggagtttttcataggaggaaataatggtcagcatcagctgtgcttcaaattattagcagaatgaaaattcaggggaaaaagtatagacacataaagttgctagatattaataagaatgcgtcttttatttctgtttctgataatattctgtgtttcttaaagctccagtgtcttaaaactatattcaggaggaagattatattgttgaggaaatgttatagtgcctcctcaacaagattattttgtcttaaagaaagaaaaaaaaccatcagatcaaacagtatataaaatatatttgtagaggttcagctttagggaagaaatcctacaacttaagcctgaaaaaaaaaaaaacaatgcaaagatcattcatttgaccaatacacagtgaagtcataataaaacaaattcctagtatgtgaaatgaaatttcacgtataggattcatcactcataacaaaagtcttattacgctctgatatcagtagacattccctcacttttggtcaccttttctaataagatcacactggtcagctgacattttgaggcaccaaattaagcatctatttggtaagtgaatttggattctctttaaaccaataaagataaaaacaaccatatcagagtgataagcatattactttagcttcaataacttagaatgtaaatatatcacagagggatatttcagctactgaaataataaaatccagtcagtcaaatagtaaaaaatattgagaaccagcaacaggaagtattataaaaaaaagcactcaagggagacacatacaagaaaccccgtcagtctactcattcagtttcttatctgttctataggtttagcagtggaaatgtttgtgggttttttttttcttcgcatttatctttgtgcctgaatgagttcagtttcgcttagattaggacagaaatttcagaacagcaggttaatccatcctgtcttcatgggcagctgagcaaacagaccaatatcagtgtaaaattgtaattctggagattaatgttgtctttcctgtttgcgatgaatttgacctccttgcctttctttttttcctcccttcttttcagcgtctgtccagggtccctgggagagagccatctcgccaaacaaagtgccctactatatcaagtaagttggaagtatcacatttttaaaagagcatttattgtgactaacctgtatattcacaagtgagtttatttttaaaatgcgacattagcctggcctacaatacctgtgtcttttttttcctgaggaagcttggataaaaaacttattctaaaattaccattgtaaatttgctgatgcaatggggaacgacttttaagaaaagtttatttaatgcaggatatatggtgtgttttgtgacagagggggcggatttttcacaatagaaccaaaagctccagataattttattgatagtgggagtcaatctttgcgagaacaatttcttttatttaggggttttctcacatttcttcttccgtcaaagatagaagatttccgcagttatatgtacacaactgttttgggtgaatgaatactacatgtttccaaaaggcagaaagcagcagtcctcgactcgtagggcttagttgttcattcttgatacataacactcagtatttgtcacctaacaacagaaagatactgttttctggaaacatttgtgccagtcaaaagaatacgagtgcttggaagcaccttctgtagtattttgcatgaaatataaatgacaatacattgggtcaacgtggaagagagaggagagaggatattgagtgattacgataccttcacagtctctcatccattgtgcactagagtctaacttaaatttaactttgaattggaaacctcaacaacaattacaatttactgggttcataaaatagtcctcgataccaaccgaagtctttgaacttgcttctgccatgagtctgactaaaaatattagatgttttcccatttttttccgcctgccatcttttatcgaatctgtttttattctttcactgtccatcaattcttcttaattcggttctaaagcaataacagcagtcctagatcttcattactacagtcctcaagaaatttgattttatgcctctattttgttaactcagaaaaatgggagtgaaggtagtcttttgactctttcaggagaaatacatactttaggaaacggtttaccatttgtcttattacatttttccagatgaggtatctcttaacttgaaaattcttttttagtatgtttgattctgctttttagttttcatattttatgaatttaattttattattgttatatttaattcattagtcactcaaaactgtacattttaaatacctatttaaatcacatgctttattaaataatatattgctgtagacatgcactgtatattaccttacatccactgtatattttatggaacaattttcttcaaactctagacagtgatttcctacatcagtgtctttgtcctcacaaatttttatttccgactaagatgtttgagacctgctacttcttcaaccaattcataaagctctcacttttatccaattcctttatgagctgaaataaagactctttttctcctttcatagatgaggttttaggatcactggagaattcaagacacctttaagctattattctccaaatgactacttgtttggggctcactagaggtctcacatggattgctagggtctccccggtcccattgtcctttccctatatattcatcttctccctgatgttacttctactacaagagatcccagtacattgctgtgagggaatggaaatgaactccgtccaaaaaataataaagagacaaattccagaaaagctgtaattcccttctgtgtattagtctcttgctgtttctcagtggaattagagagcagctacatatcctatttgtccaatgctccttcatgtacctaaagaccatggtgatggtattgataagggcacagatctatgaataagaaaacttcaattttagtcctccagtctagtcttagaggctctgtcattaggcgactgtatggctttaggcaagtcacttaacctataaaaatcttggtttctttctttttttttttttttttttttttttttgagatggagtttcactctgttgcccaggctggagtgcagtggcccgatctcggctcactgcaacccctgcctcccgggttcaagcaattctttcgtcttagctcccgagtagctgagactacaggcacctgccaccatgcttggctaatttttgtatttttagtagagacgaggtttcaccatattggtcaggctcgtctcgaactcctgacctcaggtgatccacccgcctcggcctcccaaagtgctgggattacaggcttgagccaccatgcccagccaaaccttggtttctaatttataaaataaagagttggactagatgatatctaagatcctttttagctctaagacgtaatgagcatgactcattcagttgtcctgtccaaacttaaaaaccgaagatctcagcttttgttcgataatatctttatttttaaaattcattattttaatgaacataatgtaaattcttactttaaaaaacaggaattttatttttccactgtttaattagctttagatatgccctatcaacccactccaatttcaccacacacctctttaaagagctcaaatcttggtatataatttaggattattatgcttcctggctcatgataagagagagagaacaataggcaggaaaatttgccaaaaggtgagtatggagaccttaaaagcctctgaaataatcagttccttgaaatgaggaaattacgtaatttctcaaaaatatctctgaaaccttatggagagcaattctctctacaattataatctctttgaaattagggatggtataatttctcaaatatgagtgtaaaatgttaaactgtaatatagggaaaacatacatgtttataaaatgaacattgtcagtaagcagatgattaatggcacttgtgtcttattagccattactattatctaaaatgttctatggaaaccaaattaatttgatgtacaaggttcggtggactttatgcacagcttaatgccgttcataatctgagatgccgtcttggtctaaaaagaacaaaaatacgtttacagtgacagtgcttcaaccagtcctcatttttcctcttttttatcttgtttgtcttgacttccagtcaagagtttttaccacagatgcccagctgcaaaaccaggtgtcttctctggctatgtttttaatgctttgtaactttttcttttcaatgctgggataaagggatcgcccacataacaagaggtttctataccagtggcacagttcctgttggttgttgaattgtgcactcattcttgagattttaagtcattaacatcttttgctctagtttgcaaatcaggcagtgtttatgcctgcatcctgacatcagcttttcatatgaggctaagaaccttgattttgatacttcaaactacgtgtttgtctagtttatttgtccacagcatacatcattgttacagttttcatattccctctcccttggggctcccttattcctgccagcatctctttcaggttatttgattacagctttcattgccactgaaaaaataatcaccaacaatgttcaacctgttacaactgccttttctactctctgccattttgtagttttttggcctactgtcaaactcatgaaaatttcaatataatagcctttaaccagctgctgcattctgttaggatttctttcacctttttatgttgcatgctcccatatgggtaaaccaaacagagccaagagctgggactctcttgctttcttaatgagttagaaaattgttcttctgtattctggactgtcaaaagaatttaggaatcccaaacatgcatgcaggatgttccagtatagatgtcataataaaagcataagaaatatcacactgggtcagaccaacagggcaactagcccggaactctgtcccagatgaagataccaatggttgttttgtcaggtaacctagtacattttaccttaaaaattcggatacatcatgaccacttcttaataatgcattgtaaatcaactggcagtgagtttatccaatggtgtcaaacttttcctattccccacttcagctttgtcttaataataatatgttccataaatgtaccgacttctatataaatataggcattttaatttctcttgaatctgcatcctttaacctcaaggaatggccttaattaaattctttgaaattcagtaaaaacatttatatttatccagagtcgactttagcctcacattcccctactaatgcttttcattttcatcttcccagtctgagaaattctaatcctttttagtcttttagtctgtccttgacggaaagataagctttccccttgattatcttagttgtttttccctggatcttttccagctctgttatatcttctttgggatgtcgtgactagggtggcccaaatattggttatgaaatttgttagcattgtctctagtttccactcactcatgaagaaagtaaatgttatttgctgtctcccattggtgcagaaatggagagatcaattgaggtcataacctcttctgcatatattagttctagccgaaggttggttttctgctacttttctgtaataccagcaaaagtgtttgaccttatatttctgccagctgtcccttaggaaggatttgatttttagacaagctggtcctttcctccttcaaagacgctgtggttgctaaatattgggaagaattcactaatgaaactcaggagtaaacctgctgactccatcagcagtaatgcatttcatcaggttccctttcgaaatatctctgaagcccttcacagaagagtgaaagatggggttcttgggaacttgctaactgctcagctttttttacatgcaatgctcaagaagcaactcatgtccaaaggagtgtttatcttttcctgctggtaattttgaatgttgtatatacattgctgtatatgttgcctgatgaccttgatcgacccttctcttcactctcaatctcaggcatgtttccacaaccatttattgcatctgagttttgctcacaactttctgctgcttcctgcttagcaaaatgcgatataaaaccttattggatgaagttaacagttgcttcagtcaacatttcttgttactgttgctgtttgtgctgacaaaattgctgatttgggttctgactgtcctgtcttcttatggcctaccattcctatagctctatttgtacgagtatttgactctctgcctggaactgtggccatctgtctagatttaccttttggtatatgtggctctctgtatcctgttggtctacattctggtttgaactcacggatcttggtctggtttttagtaccagtgttcccctaactccagtagcatctgaatcttgacaccaccttcccctgccccctactgtattgcctctattactactttcatggcaattttttcggattccaaatatgtcccatgcttaaagcatatcttgctctcattcttgttctagcccctgttggtaccaggcattgctccaattcaagttttggttggttgatttcttccttcataatattgattgctatttcagtacctgtatttatatacagagggagcagtgcctaactacatcttagccttaacagcaatcaacgtgttaaatatccctgtgttggctggtttgcagtagacacgtcttctgacaatgagatgggctcttattataaagaaactggagtatgatatcaacatagaaaacatttcctcaggccgggtgcggtggctcacgcctgtaatcccagcactttgggaggctgaggcaggcagatcacgaggtcaggagatggagaccatcctggctaacatggtgaaaccccgtctctactaaaaatacaaaaaattagctgggcgtggtggcgggcgcctgtagtcccagctacttgggaggctgaggcaggagaatggcgtaaacccgggaagcggagcatgcagtggacgagatcgcgccactgcactccagcctgggtgacagagcaagactctgcctcaaaaaaaaaaaaaaaaaaaaatttcctcatttcttattccagacacctcactcttctaagaatgatacaagtcttctgacattgggtttgaaaatcagttgaattttgtcataatctttcatacaatgtgaacacatcatgtagtatataattttgtgctatttctggtaagatccttcttatgtatatttttcttcaaaatataccttttagcagctaagacaacattaaataggggaaattttaaataggctaggcatcgcaagacttgaattctagttccagctttactgtcacctagctattaatacttgaccaatgggaaattgcttattttctgtgggcctcagtttctccctctgtcatttaaggaagcagaatgacatgatatcataggtcatttccagtactaacattttctgattttgtgaatgttgacttcgaaatagaaattgtttgtgatcattttccagagaagtgaaaatgaatcttcatattgcccttgaggattcttattgcaccatcaatcttatcgggatagaaaggacaaataatattaaatgtttcacttaactatttagcactattgatgataagaagtggatgcaacagagaatcagctgtctaatttgatctgtcagtctttgaggatgctggtgaatgattcggggtaattaaatttttgaaatcactgccaaaagcctgatgctctgacttttcaaaaggctttagtacacaaagataacccagaggtcaatcttctctgctgtgttttctcctctgccatttgatggtttcaaaggtcacgttacctgagtctcagtaagctctggaaccacaatgaaggaatagttggtaatacattattgatgatataatcatgaaaacaattcaggttaagatattaactgaaagagagtgaaaggggtgccatagtgttgtgcagagtgctgagtctggttttggttttatagatcttgttgggagatgtagatgttgatatcatctgtgtctcataggttcatgaaaaaaaccctcacatccttttttgtagtttcataagctgatttgtatcaccttgactgaaataacagactccaggaggatagctgttgttatctctttttctagcatagtgcctcacagataacaggtacttggtaaatattggaatgaattcatgaacatatgtcagtaattctatgtgcttttcagtttgctgactcatttcaccttcaaaacaatcttgtagtatttgtgtgtcaatttagatttaccactcaaatccatctctcatgccctctagacatgaactttagtgttaggaagcatgccgagtgtttgatagagtttctcatagctcctacagtttggtgcttaagggacagtccttggcatggatgtatgaatggtacataccaaaacatgagttctagattccgttctatcttaatctaacaatatgataaggagtataacttagctcaacctcaatgagaaggttgaactagataatgcctgggaccactctcagctctagctttgtttcagtagaactagagtctgtttttcctaaatatcattcatgaggcttcttctggttttctagtggtcaatagagctttaaattgatcaactactgtttttcactgagcattgtggacaggacctactttttgggccaggatatagtagccactgagtcttaacagaatgtcatcaatgatacatttttattttacagaaaaatgttgtaacattctatatggcatatgtcatgtggaaaggtggcaacatatatacatacacctatacatgtggcagctaaaatttaatgtgtgtatggggaaaataatcctgtattataatacacatggtatagcattccctgcctcattcgtggcacttttggaaatgtgagaatgagcatagaacatattcaagttggtttatccaaaagaagaggagtaaattatttcagctatttccccattttctttttctaactttcttaaacatgcactttcttacataatcacgtgttagaaaaaaaccagtagtcacatcaaataaatctgcatttgaaacaactgtatcatatcccaactctgttcgtttgagccatttgcttaacgtgacacccattctactttatgacacataaggaatattgcttaagaaatgttaattggctttccttttctcctctgaaactggattgaagtcttattgacctctattagatactgagtgttcaggtttttaggaaaacactcatagagatatagccccagtgtgagctgcatttttagaatattttctagaacccaaatatgtccctaatcaaagttagtttattttcattcttagcgttcccacgtaatttggggtatgtgtgaattcccaaacattcccgggcctctcctaggcttctctaattgcttcttattctgttcccctgggaagcagcatcctgttcccttcacaaaggtcagcagcaacagcccaggcaatgttttaaaataacttaataaccctgaactgcctctctcttctttgggataatttccttagagcattagtcctttgaacactgacctggttgcagaaaatgcccctttctcagtgggaaaactccaaatcccattcagtcttcccctccttccttccaggggatagggtgggggagtagggggtagggagagggtattaaatactttcttcaggaaaaatgttaacacggtaaaacactctctctctctctctctctctctctctctctctctctgtgtatgtattcttttttaaagaaatagactgtgagtgcattgtataaatcagtgctgtcacgttgcaaattttttaaaccgttgtacaagatagaaaaacagtatctctggatattgactctggaaagcttctaagagcaggtcctagatgagacttagctcactgtcggcattcggcaaatgatcacgttttctgtgataccattaactcctggggggatgaaactgaaaagcctcgctgctcttcctgaaactctcaactgcttttttctgtttttctttctcagcttatccacatccatcttggtccccaaagccattgcatgtcagatggtcagtgcaatgtgtaatttttaacttgcttctttgttgctttagaaggaatcgttttgttgttttctttccttttggtcactatttcttgttcatgagttttctgtaaacagtgtgtctcatagataagtccatgtaatctgctagacaggaagaaaagcaaagtttaatgtgtgcctactatgtgctaaatgacaaagtgtttcatctgtatcttcccatttaatccttgtaacactccacttattatccaataaagaaaaaaacggctatcagtcgggcgtggtggctcatgcctgtaatcccagcactttggcaggccaaggtgggtggatcacttgagctcagcagttcaagaccagcctgggcaacatggcgaaaccccatctctaccaaagatacaaaacagtagctgaatgtagtggcatgcacctgtggtcccagctactcaggaggctggggcaggggaatcccttgaaccagggaggcggaggttgcagtgagccgagatcacaccactgcactccagcctgggtgacagagtgagaccccatctcaaaataaataaataaataaaagttaaaaaaaaaaaaaaggaagaaacagctgagattcaaaaaagttggaggcttatccaagtcattctaataaaggggaggggggagaattgatacttaaaatcatcatgataagaaggatagacattggagattcagaagggcagaatgctgggtgaggggtggataatgagacattacttaatgggtacaaggtgcactactttggtgatggatacactaaaagcccaggttcaccactatgcaatacatccctgtaacaaaactgcacttgtacctcagaaatttatacgaataaaaataaataaatcaaataaaataatcatcatcatctcagctattgcttctagctgtttcaactttctaatgtttttgattgaaaactggccatttgtataaccaaatgtggccaatccaccactgtgaggctgccatcttgggcatcaccaaaactactctagtagtccttccctgcactgttaggtggattttccttggcgtatcttcgcaatcaagttgcagagacctaagttactctttgctgctttgggcaataaaggggaacaaaaaacaaaatgaaacaaaaacttggccagccctgatgtaagcactcttctacctccctgcaggctgagaaaacaaagtatttcttttttttttttttaatttttaaaatgtttgattctggtctaaatcaattaaaatgagatctccccccttcttttttctttttttcttctaaaaaaaaaaaacacaccaaaaaaccgagatacatgtgcagaacgtgcaggtttgttacataggtatatgtatgccatggtggtctgctgcacctaatgacccatcgtctaagttccctcccttcaacccccaaaccccaacaggccctggtgtgcattgtttccctctctgtgtccatgtgttcttaatgttcaactctcacttgtgagtgagaacatgcagcgtttggttttctgttcctgtgttagtttgctgaggatgatggcttccagtttcatgtccctgcaaaggacgtgatctcattcctttttatggctgcgtagtattccatggtttatatgtaccacattttctttatccagtctatcattgatgggcatttgggttggttccatgtctttgctattgtaaatagtgctgcaataaacatacatatgcatgtgtctttatagtagaatgatttatattcctttgggtgtatacccagtaatgggatggctgggccaaatggtatttctggttctagatccttgaggaattgccatactgttttccacaatggttgaactaatttacattcccatcaacagttcaaaagcgttcccatttctccacagcctagccagcatctgttgtttcctgactttttaataatcaccattctgactggtgtgagatggtatctcattgtggttttcatttgcatttctctgatgatcagtgatgttgagctttttttcatatgtttgttggccatgtaaatgtcttcttttgagaagtgtctgttcatatcctttgcccactttttgatagggttgtttgtctttttcttgtgaatatgtttaagttccttgtaaattctggatattagacctttgtcagatgggtagattgaaaaaatgttttcccattctgtaggttgcctattcactttgatgatagtttcttttgctgtgcagaagctctttagtttaattagattccatttctcaattttgtcttttgttgcagttgcttttggcgtttttgtcatgaagtctttgcccatgcctatgtcttaaatggtattgcctaggtttccttctagggtttttaggatttggggttttacatttaagtctttaatccatcttgagttaatttttgtgtaagctgtaagggaggggtccagtttctgttttctgcatatggctagagagttttcccagcaccgtttactgaataggagatcctttccccattgcttgtttttgtcaggtttatcaaagatcagatgtttgtagatgtgtggtattatttctgaggtctttcatggataggaagaatcaatatcgtgaaaatggttatactgcccaaagtaatttatagattcaatgctattcccatcaaactaccatgaccttcttcacagaattaaaaaaaaaactgttttaaatttcatgtggaatcaaagaagaccccgtatagccaagacaattctaagcaaaaagaacaaagctagaggcatcacaccacctgaattcaaactatactacaaggctacagtaaccaaaacagcatggtactggtaccaaaacagacatatagaccaatggagcagaaaagcaaaggatttctaagtcatattccaccacctccatcagggcttccctaagatagagagtatggccaagaccatacttaataaatgtcatggaatgtgtttctcttcataccctcaattgtaagtctttctgaaaggtagcgcgtggtcaatttagatggacaagaagtgctctgcaggagcctttgcaacatttgtgcatgtccttgattttgacaccaccccccgccccccattccagaacagatcgtctcatccttcccttaagccagaggcctatggttctagctttactaggcaaatatatatggtctgtggctataagtcacaatttctcccaagccttgagctgggggaatactgagtctgcccatgtattacatgcagaacatttcatcttattgcagaatgatactttattcttattgcagaatgatattcattattgcagagtgatattctttagtctttattttttatcattataactacatggtgcaaaagaagtatttctcatactttttctcataatgactcaaaattacaaaagcaatctgggcaattaatatgtttttgaagataaataatggcttatgttttctgaagattaagaaaaatctctgtctgaatatagctgggcacagtgtctcaagcgtgtaatcccagcactttggggggtcaaagcagaaggaacacttaagcccaggagttcgaagccagcctgagcaacaaaatgatacctggtctctacaaaaaaaaaaaaaaaaaaatccttggcatggtggcatgtgcttgtggtcccaggcacacaggatgctgaggcaggaggattgcttgagcccagggggccgaaagttgaggctatagtgaaccgtgtttgtgccactgcactccagcttgggcaacacagcaagactctgtctctaggaataaaaaaaaaagaagaaagaaaagaaaaatctctatccgaaaaatgtaggcaccctgtgttaatatgtaaatacaagtgctttatcaaataaaggctagattaattgttttttctcgctcttacttatatcaatactacaagaacttttctgccaaaaaaaaaaatcaaataatagaaaagaatgaatcctagatagagcaggaggggctgagcaggcacagcaaaagttcaaggtggaaatatctttatgcatccaattaaaagtaatttgtgtacattttactcatatatctatatgtacacatacatacatacacagacacacacacatatatatatatatatatatggagagagagagagagagagagagagagaggacaacgaagaggaaactaaagagaataaagggtattaacagcaggtctgtgacttattccctgggggatgtgaagggaataaatgaccttaatagaccacttcataaacatgttaatgacctcccagaccttcttgtttatcttgttaatagtggttaactagaggaaagatacctgcaaatccctatctataaaatgattttagtagggtatacctggcctggctagatagcttattgtaaataaacctggaatgtttggatttatgagtcgtggctggctggagaatagggcatagctacatgaacgtttttctatttttgtaattgacagattataaaatggaaaacttttgagactgaaatgatttcctttcaatgtttctgtgtaaatttttaaaaacgtatctgttaatatgaaaccaaagcacatcataatgggaaataacatggatgttttggaaacgcatgtgtgattatttcaggttccccagggaaataatgttctatctgtgcccagcacttccctataattctttcagtcattaataaagattggtactagataagaatctgagatttgtgtgagtctgatgtgagatccaaatgttatacttacacaatttgtgtttattttagtttaaaaattatctttgccatgagcaagaggggaaaaaaaggaggatgagcgggcctacatatttttccttaacatcttgtcccaagttttaggaaatcacaagtctaagaaaaggccagggtcaggactaggaagtgatataacagttatacatgtctacctttaaaattatataagtaataattaatttttaaccttattttaagcagatcctagaaatagcaagagcctctataacgtcccagctaagaccccaagttttctttcttgtttaactcttgaaatattttgttaattttcagatcccttgtctcctcagttcagctgtaaactctctgacaacgcttgtgccttatgcatctttgcatcatccctagcatgtattatatatctcacatgtaaaaataataataaatacttgatcatttgttttgattttgatgattaagcactggaagctgagctatgatcccaataggtatgcttatttaaagaaaaatagatggcagtccaggcgtggtggctcacacctgtaatcctagcactttgggaggctgaggtgggcaaatcacctgaggtcaggagttcaagaccagcctgtccaagatggtgaaccccgtctctactaaaaatacaaaaattagtctggtgtggtggcagatgcctgtaatccccactactcaggaggctgaggcaggagaatcacttgaaccctggaggcagaggttgcagtgagccgagatcgcaccattgcacttcagccagggcgacagagttgagactccatctccaaagaaaaaaaaaatcacacacaaaaaaatagatggcacggcacagcagcttatgcctgcagtcccaacactttgggaagccgaagcaggaagatcacttgagtccaggagtttgagaccaggctgagcaatatagcaagactccatctagaaataaataaataaataaataatttttaaaaaatagacaataacagataaagaagttccatgttatttttttaaattctagatagccccactggtgttacagtttattaaattacatttggaagcgattttttagcagtccatttattttgtatatttcagtttgttgagagcagatggggttgagtgttgatggggttgattgcctggctagattatgctataaactataaatctttgaaagttactgttttgaagaaagcatctttaagtgaatatattccttcagtagctcctattaccaaaactgttgtgagaatatcttaggaaaacaccttaaaatcctcttctatcaaaactcccaagctttcttcaggagccagcattgttcagtgaatgcatgtaagcctatgtcttaatagagggatccctaacctctggaccatggactggaacagcaggaggtgagtggtgagcaagtgaacattactgcctgagctctgcctcctgtcagatcagtcgtggcattagattatcgtaggtgcacaagccctattgtgaactatgtatgcgagggatctaggttgtgacctctttatgagaaactaatgcctgatgatctgaggtggaacggtttcatctcgaaaccatacccccgcccctgcctcccagtctgtggaaaaattgtcttccagaaaactcatgcctggtgccaaaaaggctggggaccactgtcttaatagatcttgaaaaaagttggagtaaggtaagtggtaaatcctaagacatacattgaggcagagctgcagtggtatccagtagggaagaaaagacttcaagtttagaattcagttatactcaaccagtttttgcctttctctgttaaatattagatatcattaccagacacatacaaaagattttaattgcatgaatgcccgatgttgatacaagagagccgatttttttttcacacatagttttttggggtttttttggtagggagaaacatcatctcatgatatcgttttaaaggtgctttattatcaaggaccttagagctttttctctcactcatatttcatatactcttagtcctcaagccatttctttttactgaaagcactatagagtagcaaaaggcatcattatattgctcagcctcattcatcatcaacaaaattgccaattatattccaagtccttgaatgtattgtttaaaaagatgtataaggtgaaaggaagcagttcaatgttgaggtggaagatgaaacatactgactggtagattcagagcatactaatcttgttttcacttgtgaactggaaaaaattaacatggagggatggagaaaacatgttcaaactacaaagtcattttttctgagaagttatctgactgtaactgtaactgtaactataactcagggtatatcagagggctcaaatgtggaacacttctttaaaattaaaacctaaaagtcctgatgtgtaatagaacgtgtaaaaatagcagcctctgaaggatctgagatgagcagaggaacactgaataatataatctgacagtatgggccatacccttacagtagttgccgtggcctggaaactatagaattaattcagtaaaacatcagaaaaaaagcaacataaatataaaatattttaaattaaaaagactgaataagaacagaaaaaaatcccctagcaaatcaatattgcttggggaagcatgaatcccagaccagcaatattttaatccaaataacttttagttccatcgtgaacacctttatcaccaagttttataaagagtggagtgaagaaaaaaagtacttgaggttgttggaaacacttctcaaagttggtggctttattcagagattcatgcttgactgtaccaacttctgtttaatttatacgtagtactttgtcaatttaggaatttggtttacttgtcctttcctaaatatgtgtattacaaaacaaaaaatagagaaatgataaaataattacaaagatgattaagcaatagtgttggctatagtgaacagattattgccattttatagagtaataatatacctaaggaaatctgtgggaaatttaatttgggatataaaacacagaagtcaggcggagatgaaataataaaccaataggaaattaaatttaggcatgagagtccaaagatgtaaattctatagatgttataaaataatatgtatgcccttacataatttcattactctctgaacttcatttctcagtgaaatatggggaaatgatactgaacagtgcagcagctcttccgcttatgaaccaaccagaagatatataaacaactcttaagggttatacattataaagatataatttagtctggatttttttttaaatttgaaaactaattttatataaaccctaattgggcaattctccattctttgacttgaatattatagtaaatatgttttcccaatttccaagtttcatgtattattttcaaagaaaaaagacaaacttttaaatgtccagctacctgggacttcctctgattatcttttaaggtagttcaaatatatacaatttcaaacaacaacaacaacagcaaaaaatattttgccagacaatatgtcttgtttgtttttaatgttcacaatgtaaagtacacttattgccaaacctcactttcaatggtgttacaaattagccaagtataactagtttgtaaatactaataagaaggttgctgaaattcagccctgaatatttcttttctgcaactccaaagaggaaaatttttgaaatgcaaaccttgacctttatcaaagcctaggtgaagtttgttggaggtgtttggttttttgctggtgctttgttataatgcagtttgaaagtagactagattggcaagacataattggctgctgtgtggagaatgcatttggtggaacacgtgagttaggggtgaggaaatatgaagagccagagtggaagcagggagaccagatagtagtgtgggaagcactggtgttagataagatctagataaaggtagcagtggagatcacaagaggtggttggaatcagggaatatggtttagaaacaatcacaggtcttgctgatgcattggaggtcaggagggacagaaagagggcaatccaggtgtctcctcggctttcagcaggaacaggtacttaaagaggaacaaatttggtagggaaaatcaagttttagtgttccattgcagtacatggtaaccatggctaataataatgtctcatatatttcaaaattgctaaaagaatagatttttaatgttctcaccgcaaaaaataaatgatatgttggtgaggtaatggatacgttaattagcttgatcaactctttctacaatatataccaagatcaaaacatcacatcgtatcccataaatatacaaactattatttgtcaattacaaataaatgaaataaataattttttaaagagatgtcttaaagggtggcttgaagagcttctgtgctccaataatacctgcccattagccatactttgcttccagcaacaacaggaaaacatttaatctaaacaaaaaaaaattgcttgtcaactagatagctactcttccgtgtagaaaccctagagctgcctgggtttagacatgtttaagtttgaggtacttattgggtatctagctgtgcagttcaaaatttggatctgaagctaggggaagacgtcaggacaagagctttaacttttgtaatcatcaatatatacatccttcttagagtcatggggtgggatgccatcatattgggatgagggaggaaaccctgggacttcacaatatcgagctagtttctgttttgcaaaaggcaaatgtattaatgaattcattacattaattaagcaaactatatttattgggggctattgtaccagctattgtaaattttatattttatattatatatatatatatataaaatgctcacaaaataaaggaactaagtcataaatatgcatatgatttacataaaggagctaaaataaggatctctgtttctgtttcaattctttattaaagatctatctaagactataaagacatatataacaaggtacaggaggtaaagagtatattcttaggcatctaaaaatttttcctatgcttttgaaatctgtgtgatttactttcttgaattggcctgtaatataggagtacaatatcattgcagagattaattagtgtgtttgtgaactgttctcaaatgctaaaatgaaagcataaaactataaaatggcatcattattccttaaagaagcatagtttccaagggtgtctctgatcattgtcacagcataaatgaccaatttcacccataattagccaagttagtaagaagttattttttactgggtatattttgtttaacctcagttatatttgtaaaagtagaaactgctacttgttactgctttcagaatttctcacaaatgctaaaatgctttttaattctaatgcacttaaatggtttgattctccttacctaagaaaaacatttatctaaagatatactcttgactgattcattcattgattcatttgtcaatagatgtttatttatcagaatatgtgcaccagatacattgctagatgtaaagggtacatttggtgagcaacatgcatgatacctccaaagtatagccagggaatagataatggaaatgacactaagaatgaatacatattaacacaaaaagagagagagagtcatgtgtcaaggcaatttagcaggagggaacttgtcaatacaagggattaaaaggacagcatgactagggctggaggaggtgaggagaaaactcaaaaagtcctctggctgatgcaaatgaattggatgaggagcctatgaatacaaacgtttgaaggttactgatgaaagccaggtgagagaagatgggatttggaccaagatgatgatagtttggatatggtgagaaaggcatagatttgagagatttttaggaggtaaaaatccttaagatttgaggatagatatcataggaggaagggcgcaaagagaaagcaaaacatgtcaaggaatcacacctagatttctgggcaatgcacagttggtaattctttacagtgagttagggaactctaaagaaagatcagatttagggtggcaatttgattgtaaatgtttggatttcaaatgattggtgacatccaaaaagcactgtaaatagacagatagtgtgcacctaaagaaagaaggaggcgcatctgggttggagtcactaatttacatattacttgtatatagctagtaactgaaaccatgagtgtgaatgagattctgatgctaaattctggaaggtcactttttaaagtgttttgctttttgaagtacaggtgcaatactaaaaataaaaaagactaatttttaaaaattaaattaaaatgaaaagcctggaaagataaacaccaaagttatgatactagttgtagtatgggagagggggcatcagagaggatcggaatttcatcttgaatggtgtattttatttcaaaagaagctttgagcaaagataaaatgttaattctgagcattagaaggaacacatttgtttttttgtactgtggatctttttgtatttcctagaactcttaatctaaatcaaatattgcaaaatatatcactgtaaacaactggttggtcactagctttttaaatactttgtagcaacttggttgcttgtcagaggtcttctttgagtgaagtctttaatttatagttctttatgcttgatcagcataattgcaccaaactgttacttaatctgaaaaatagctgtttcctagagccctacttaatactgaaaacctactgtgtttgtattgcaattgcatttttttttttacttttccccctgcttttcagtttgtataatttctgttaccctatattcaagttcactggttctttccttgtctttgttgaatctacagatgagcccatctaaggtatttttcttttctgttactgcttttaatttctagcatttccatttgattcacttatagtttccagctctatactgaaatatactgaaatatagagctggaaactataagagtgaatcaaatctaatcttgcatattgtcttctaatcttacatattttctatctaatcttgcatattgtctttcttttccctcaagagtctttaaaatattaattatggttattttaaatttcctgtctgatagttccaacaactgttacatatctaagtctggttctgattcttgctttgtctccttagactgtgatttttcttgcttaggcatgctttgtatctcaggggtaaaagtcaggcatcttagatagcgtaatagatactgaggtaaataaacctttgacatggtaatttatcttaatctgactgggaattgggctgtgtttgatgttggtagttgctttggttgtcattgttgagttttgttgctgctgtggccaccagagacttcaaattcctctggtaactttgtttcctcattggaagcttgttagtgtagtggttgagtgtcgggcagaggcattctctaatgtttgaattaatacacagttggcctgggtcttggggatgtggtctttacaattatttctttcccttcctccagaggtagagtaacttcaacctcccattcccttcctggagctgcagtggatatccaccagtgttctcagtctatggccccaaggccctttctcctgcataaggctgaaaaacaacaacaacaacaaacaaacaaaaaaaaacaaacaaaaaaagaacaaaacaaaaccacacatagatgagatctggtgttcccttcccctaaaatgcagtggtatttcctcagtgcctgatatggtttggttctgtgtctccacccaaatgtcatgtcaaattgtaatccccacatgttggaggaggggcctgatgggaggtgaatgaatcatgggggcagatttctccgttgctgtacttgtgatagtgagtgagttctcaagagatctagttatttgagagtatgtaggactttccccttcactgtgtctatcctgctgctgtgtgaagatgtgcttgcttcccctttgccttctgccatgattttaagcttcctgagggctccccagccatgcctcctatacagcctgcagaactgtgagtcaattaaacctctttgctttataaactacccagtcacgggtagttctttatagcaatgtgatgtcttttcctctgaagagaagggtataagcagattcatggtgactagctactgtgacccttccccaatcagcaacacagagggtgttggggaggctttctccagattcttcgcatcctccttgtgaaggcaaggtacagttcctgaaggaagaagcttgcaaaaggttgggactccacctatggcagtagcccccaggatcttcacactctcaggctagctcccacatgtcccccaacaatttaatctccctactagtttatatggcatctgctccagggatccaaatgctcaggcactgcttctggctaaaggccaatctctctccagatttcaggttgttctataatgtcatttctctgatggactgatgaaaagtcattaatttatctgtccagcagttttcttgctacaagtatgggagcaacctctttgcagctctccatctccatctccaagttgaaactggaagtctgagcaatacattttagaaattaatatttgtaagttttccgtgtcataacaaaaataataaatgttcactgtggaaaacatagaaaaagattaaaaatatttaagtgcccatcaccacctagacaactgcaatgaacatgttggtaatgtcttcttccagttttttaaaatctgctgataaaatacaaaagatattgtttatataactttgtatcctaccttttcttgagcaatgcaagtttaaacctaaatacgaagatactctaacttcctactttacatttttgacggcagatgtcagctgtcttcccaagtgcagtacccttggcttaatatcaggtagacaaataaggccaccacaaattcacctttcacctcaataacacaggtaatttgatagttctacagaccctataatattacttgactgaagacccagaatacaagtctttcaaggattactctagaaactatataaagtattggtatcatctcccttcatcatatcttgccaaatccaacaggtttggaacttctgtaggaagatttttgtaacatgaaaaatgcgtgttgcaccttccatatccagcaaatacaccatcggttttttgttggctgcaccaatgacataaaatgatttcactgaatagggggtgacccagaatggaaatgtagagcatcgaaaataaaatcaaccgacgcagtctttgcagcaaaccatgtggaaacaaatttaaatatggaacatactctttccaactcatcttcagatgttgctttaaaatttgtgcaggtgaaaaaaaaatctttattttaaggtaactcaatcttttaccattggagagaatagaattatttttgtttcctcttgtatattcccagttgtttaaatgttctctgtttccttgtgtggacacataaatccaaatatatctaatatcaaggtatttaccatatgcagcactttttcctcagatagttattttttgaaatattcaaatagcttacctgtatcatcccccccatccttttttttttttttttttttttttaagacggagtcttcctctgtcaccaggctggagtgcagtggtgcgatctcggctcactgcaacctccacctcccaggttcaagcgattctcctgcctcagcctcccaagtagctgggactacagttgcatgccaccatacccagctaatttttgtatttttagtagagacagggtttcaccaatttggccaggatggtcttgatctcttgacctcatgatccacccacctcagcgtcccaaagtgctgggattacaggcgtgagccatcacacccagcctaccctattttctaaacgaacaattagttgacttttcttcagttcttactcagaaatatctgaccctaggttccaacttttgttttgctctttgcagttagtttttatgtgtactgttagggagatgtgctttttttttaccttcaaatttaaaagagagagttttcaattccttttaagtcaaaatacaactgttctactctaaagctttctttaaaaaaagaaaagtaccaaatcctcatccgtagtaattaattttgacagtgtaggctcagtagtgattcacaaacctgtattttgtgcatcagcattccttattattctaattaaagtggaacattgtgccctcgctaatcattaatgggttttcattttgtaaatgacatttgcagaagttaaaacagcgagttcatgtgaagtccacaggcaacggtgttgaaattagcatcaccatagcaacagtcttccatcattagcattcagggcaacaggaggtgttttgttgtgttttgtttcccaaaaaaagaaaaagaaaaaaacttcaaaggtaaagcctacagaaactctctcagaagatatttatgttccttgtgtgtatgtgtactgtactagacctctaagtctacatagaattttttttaaaaattgcaatgtggatcatctcctttccagatttgtgttttgcctagtatactagctaaatttcatgatctttctccagctgtacacgtctgacctgctgagcagcatttactcattgccaacctgctgctcaccaatagggtttcctacgtggatgaagagagtctgtattcatgaaaatatttggttcaatctaaaagtattatgtgtattcatgagtttttaatttaattcatggaaaatagatttatgctgttagatcctctggtgaactcatttagtcatgttgtagatataggtcaatgattattctcattcatgtttagacggaattaaagaggagtcaaatagagaacaatattatcttaactgagtctctggcagtggtattaccactattactctgtatgtgtgtgtgtgtatgtgtgtgtgtgtgtgtgtgtatgtgtgtgtgtgtgtgtgtttgaattctaatattctgggaaactttaaaagtggcatatctagcacttatgtttttctcagtactaaaatgcataaaagagcaccatattgacctaccagctgcttctaaatcacaccagtagtaggtaattatgaaattcaaatgaagtttaattttcatttattatacaaaaatgtcatagctcaaacccagaagtgttacccccaagcttggatatagacaggtatgtgtgtacattttacttttcaagatgaatcatagcagtcttctccattacatgtaaggactagaagttgtacattccactcaggtacctaaaggcaagcctgtgctagcccacactaacaaagcaaaatgaagcaaaggatctatctggctttcaatcagggatgcatctatgctatcatcagctctgtcacataataaatgagtctatagataacttgaactactcagccaatgggctgtaacccagtgattctgtggtattgaaaggcagcaacccccagaagccacatgtctcagtgtgcactccaggactgtaggcccatagaacttgtatgtatgcacacatgcatatgcattccccacttttctaatggcgatccaatctaggcctaatccacagctagtccagaaaagaacttttttaggttttctgtctgccatcactttgttgagaggcagtacaagccaagcaggtgtctgtatttataatatgcacaatgttaggataactcaaactcataagggaaagattaatggctgactactatgaaaaccgcttctagccttgtgataccagcacctactatcttcctttttctcttatatgatgaaaagatttcaatgttggcttttcattctgatagaatgtgcaagccaaaatctaaataaagtccagtggcaatgatccccttaaacattatatctttcttctcgatatgctgatgttttcccttataaaaatctatgtaagtttcaagatttatatgacagacaaaccacacaaacaggaggtccctcacattcactactagtcacttgctctatcactctgggaatagcggtcttcagattgcatctctactctacctcttgctcttttcaacccctctcctcttttttagaccatacagggcatcagacaaggtttagtttaccactaaactttgggatttggaagatggtgtataaactgatacaggtagtccactcacagatgtagtatataattacagacttgagttttcaggggctcttctccagtttcctgtcaatcaatttccctggctgagacattagcatttgtcagtgaccatgcttactatatacatacacaattgtgtatacacaattgtaaaattaaatacgggctttagaagagattattttttcttaagagtaggttactctataaatgccaaagcatgtgttatgacatagaaattcaaatgactaagaatagctaattgtttagaaacatcttacttgatgtctattgttccaaaatttgatccaatttagagtggtaccaatccatggtgtagaatataaaagctaaaggataacaaaaatcctaggaatctcatgccagtaagaaagttctaccagtcagatgagatgttgagagcatttatgacttggcatcaggaatattataagtaaaattcatgtgagcagtaattgcagctatgaaccatgttatttgttcccacttgtccaactgtaattctttcacttagctcagagtagttctttgtaacattagggcccactcatctgcctttaggtagggttttaaaagatgcctagaaaatagttctgtgctagaaatcagagactcttgacctactgtaaagggagcagtaagcacgtttcctcaggagaatctttctacatactgcagattcccataaaaatctttgtgacaaaattgcctttactgaaaccatcatccattggattaaaaaatagcttaccattagctttttgaaaatagaaaacgttgagccttttcaatgatactttcaatagtttttcacaactatgagtcctcaagctatcagtcttatttttagataccatacttataagatagttatagaatttatagagtatggtttaaaagactattcaattatagagcaatcattcagtttattcccatggcagaagtaaatggaaaccactccagatcaacaagaatctactctcttctgattcagaaaagagatttcctatcttttcatgaataatccatgttcaatgtttaacacctcaggaagattttcttaatagcttcttctggtcataaatccttggtctgtcatcagggacatattgaagagttagttaccaaagttcttaatgtctcccattgtaaaaaaaaaaaaaaaaaaaagtcactttttggattgtttctttcatagagtccatgcttctgtacgcttaatactttagcttttgacttcaagctttaggtaatgcaaatgaagctattacatcaccaaagttaaatttttcttgtaagtatattctcaacattcacaattgagagctgcctcttctttggctggtataaggttttaatttattgtagcactttcaccctagaatggcaaaaaatgttgaaatcaattccatatatcaccaatacaaagtactaagtcaaggccgggtgtggtggctacgcctgtaatgcaagcactttgggaggccaaggcgggcagatcacttgatgtcaggagttcgagaccagcctgaccaacatggtgaaaccccatctctactaaaaatacaaacattagccaggcgttcatagcgagcgcttgtaatcccagctacttgggaggctgaggcaggagaatcgcttggacttgggaggtggaggttgcagtgagccaagatcatgccattgcactctagcctgggtgacagagcgagtctcaacaaacaaacaaacaaaaatattgaattgtacaccttaaatgggcgaatcgtatggtatgtatactaaatgtcaataaagctgttatatgaaaaaaaaatgctaacacacacattctgaaagtatattaaaagcaaacctacggccgggcgcggtggctcacacctgtaatcccagcactttgtgaggccgaggtgggcggatcacaaggtcgggagatcgagatcatcctggctaacacggtgaaacccagtctctactaaaaatacaaaaaattagccaggtgtggtggtggacgcctgtagtcccagatactcgggaggctgaggcaggagaatggcgtgaacccggggctggagcttgcagtgagccgagatcgcgctactgcactacagcctgggcaacagagtgagactccatctcaaaagaaaaaataaaaataaaaaagcaaacctacaatgtctcttacaaacacaggcaactattcaattccgagtttacactactgaaacacacatgaatatgacactaagagaatcacgtggatctgcactcttcaatcaacactacgtctctgagcacaagaattttacatctgatttccatttggggaaatagattcagaatgccataaaccagatacttcttgccttcctttagtggtcatttctgccattatcatttaagggaatggatctccttctcccaaaactgttaccctaagattacaagcttgtcctttaacttatctctgaaagcacacctctataacgggtcatcagtattcagtcagctaattagactgcagaagtacgtttactcaaatgtgaggagataaaattgtgaaatgtaagaggaagaaagaatgtcaaagataatccaacccaaactcttcatcttacagataggaaaatggaagtccaaaaggggaaagtaattttagtaacatggctaaactggtctagaaaaccagatcttctgatacctgatcccatggtctttctaatgccatggatgttcgggtagaggatatattcaggtagataacttatagatagccccatgtgtttgtatagcactttatcgaacactttcacctctattatcacacttgattcttacaatatcccatggaatgtttgagtatcatatatgattattcttattcccacagacttggaaactgaggctttgagatgtctggatctatcttagatcatttgctatggactagaatctgggactaagttgcttttgtctaagctgtgtgtttgttctgttgtgccgtattgttaattcatttctgttggtaaacaacacaaaggaaaaacttctataattatgtttctttttcatcctcaggtcatctatcctactttttatctaagctttggaaaatattatgtgctttccttttttttgtattttcttttcgtagagatggcagcagggggtagtctcaccatgttgcccaggctgacctcgaactccttggctcaagcgatcctcctgccttggcatcccaaagtgctgggattacaggcgtgagccaccacacctggcctattatgtcctttctttagcttgctcgtttaaccatttgtttggcagggggagtcagaactgtgttttacttagtcgattaactgataggacaatttaatatctaccctgcactggcagtaacccccatagccccgctctgtgtctcattctgtgccctgaacaaccttgtcttaaaaacattttaaaagcagcaagtatggggagatttcttatctccatataatacagaagcaagtgtagagtatggctacggaaaacaaccagcaggtgaggctgtgacataacaattttaacccaagcctcactgccacattgaggtatccttgttcaataaatagatcagaaaatatggtgtagtttttccctaacgctgtctaaacagcaacaacaaaaaatcattacccatagtatttcagtaatgtgttgtattgaatgcattgttttcgagggcgttttcaaaaaataagttgattgaatctcttttttttgcttgaagaatgacccacattcagaaagtatacagatgaaacatgttcagctcaatgcaattatcacaaaatgaatacacctatgttcgccatctaggacagtaaataaaacattatcagtagccctaaaccagattacacacacacacacacacacacacacacacacacacacacactaaaccagactacacacacacacacacacacacacacacaccgggttgggggagtggtgagagagagagagagaaagcgaatattatgttaacagttggggagtctaagtgaatggtttatgggtgttcttttaacatttcaattggtttaaaattttcaaaatgaaaagcttgaggagaaacatagaatataaccactacctcagaaatcaccaccctacctcacccacattccctctcccaatcactattcctccctcatcttaaaggtaactgctactctgccttataacactatggttgagttttgcctgtttatttgaactctataaaaatggaattgtacagtatataaccttttgtatctaggactcaacattgtgtttatgagattaactcatgttgttgcatgaatctgtcatacattttcattgcaatttgatatcccatttaaaatgtatactataatttatccattctattgttggggaacattttggttctttccagtttgaagacattatgaataaggcctcctatgaacattctttaatgcgttttttggcacacacgtgtgtacaactgtgtttggtatatactttgcagtaaaattgcctatgttgagggtaggcatatgctgagctttagtagatactcctggttttccaaagtggttgtaccagtttacaccatcattagcagtatatgaaagttctagtagctccacatctcaacaatacttgatacttgttagtctttaaaattttcgccattgcagtgagtgtgtgagtagaatctcattgttattttaatttgcaattgtctgattacttatgaggttgaatatttttacgtgtatttattgaccattttggatatcctgttgtgtgaagtatctattcagtctcttgcctattttttttattgattcatccttctttttcttattgatctgtaggagttttttttacatattctagtttgtagccctttgtaaattgtatgtgttgcaaatatcttctcccattttatagctttccttttaattaaattgtttttttgattgatagttcttaactttaatatagtccaatatgtaaatttttccttagggttaattcttttgtgtcctctttaagaaatctttcctaatacaagataatgaatgtatcctcttttattatcttctagaaacttactattttttaacttttccatttagatatatagtacacctggaattgaccttttgtgtaatatgtgagatagagattgagttttatttttcataatatggatatctagttggcccagtacttgatgctaaacattcatttagaattcatttgatagtatttcctttagagttattgcatctgtgtttattagttatattggtctgccattcttgtcaaggtttggtatgtggattattctggtttcataaaggcaagtagggaagcattgcctcttctagtctctggaagagtttctttaagattggtatttctgccagtgatatgatttggccttggaattttcctagtgggaaaatttataattacagtgtttatttcttaaatagtacagggctattccaattttctatttcttcttttgtcagtgtcagttgacttaaagcacactaagatactctaagattgctatggtcagcctttgctggtctaaaccagaggttgcaaactgaaatgccaacagaggggctagcctgctactgtaactgggcaaggctagcgaagcgtaagttaatgggagctggtagggactatagaatacatgtgccgttatagaatggtggctccggaaagttattgtcatgcaagaataggagcccagcatggacaaatcattccttttaaatgagaagtcagaaggttggattattctgtaaaatatctctgaatatttaaatgttgagtaattcagattaaaaaaaaaaaaactgtgtgggctaatcaaaacatttgtgcatgccaaatttagcccaaagtctgctagtttgcaacttgtactttcaactaatgaaaagcgtaatagcacagatataattccattttcaaataatataattcatttatagttgacatttatttaatttacacttaaatatgaatttgtcatttaatttaccatattaaaaaagtttagattttaagacatccaagtctgcaaataactagaatattttcatttactctcatgtttgtgtacttatttttccttaaatgttattttcatgatatacttagtgtcttgtggacattccaaaaaactgatttgacttaaattgtcctcactccaagctttaaaattgcttagttcatagcctaccttgcctaaagcaaacctggtagtctcatttcaagttactggattttttgtttgtttgtttgtttgcttttgccttgtttcttttcaaggttatatagagtgaaggaatatcagacttcttttaatttttgcagggaattcagattgctgtggattaagatcctatatataagatgcttaggatagaggcatcatgaatgaaaaattattcatatgaacacactttttagagtattatttttattcattcagcaaataatcatagctgccatactaggcaggtagggaccatgaagactactgtccttgtagtctaaagtcttgtagactaataagatatgtataactgttaaatagtacactgaaaatacaaccttaaacaatcaaaatatttgcaaattgtatttagttgacatgattgcataattgtatttatgtgacaattatatttgttattcacatatttagggagtcaatatgtacttaaggtaatctttgagctattttcaggatgaggtattagctcattactattaatactaccatcaccaaatgcattacctacttatctgcatttccaggaaaaattcaggaaattaggatttttaaaataataaaataatagtaaataagactgggcatggtggctcatgcctgtagtcctagcactttgggaggccgaggcgggtagattgcttgatgccaggagttcaagaccagcctggccaacatggctaaaccccatctctactaaaaatataaaaatcagccaggcatggtggcgtgcacctgtaatcccagctactcgggaggctgaggcatgagaattgcttgaacccaggaggcggaggttgcagtgagcagagatcatgccactgcactccagcctgggcgacagagtgagactctgtctcaaataataataataataataataataataataataataaacagaataataacctaagtgactatatttgatatatagttaagtgatgtttttgtagactttactaaactaaaaaataaattagcagttatttaattttctagtttataaagtacctacttacataaagttgcatatattacttcatttaattttaaaagaatatcgtaaaatatgtaggatagatttccattttatagtcaacaatacttattatttcaatacattatgtgattttttttcccccagtatcacagtgttagagcccaggttcaaaccagcattttctaactgtaagtctggaagtctgtctgcttactctatgtaagatgccttatgaagttcatagaggagacagctcagtggattcaggcctggtcttatattttgctgttcatcttgttttaagtgttatgttaagcaaataaaacataactttaaacattctgtttacttttaaaatttgatttagagctaacaaaaattagaatttgtactccatttacaacgaacagaacaaccaaataagcaaaattgtatttgcgttgtcaattacaataaataattataatggtatatcagagtgttaaattttgatttttttttttttgagatggattttattttattttttattttttttttttttgctctgtcacccaggctggagtgcagtggactgcaacctccacctgctgggttcaagtgattctcccgcctcagcctctcgagtggctgggattacaggcacccgccatcatgcccagctaatttttgtatttttatagagatagagtttcaccatgttggccaggttggtctcaaactcctggccttagatgatccacccgcctcgacctcccaacgtgccaggattacagatgtgagccgccacacctagactaaaattttatgttcttatatttctttaaggaaagcaaaaatgttgacagagagggttaatactagttatatatacaaaaaacctaaaaataagattttggattattctattatatgattattcatttattgaaaatcataaactaattgaatgactgagagcagcactaatgtgattactttggtaggaatctgtcctccaaagttgtcagttgtcagttattcttagcattttgaactgaagtctatgtaattaagtcacctgttgtttctgacaaaatgagcaaacacacataaaatctcttggttcgtcttcatgtctctgtggcagagaactgaccacattattcagttcctttgtcctttttagacaaaagccacctctacatggccctataagtcttcaattcaaggactatagccgttatcttaatgggattgtacttggttatctgataaattgtcgggaacatacccacattgcttcctttacctgacataaaatttagtcagctggggctcaacgattgaccagctttatcttgcacgtagtgaagggaaggactttcttactcctggatgtgcctaaatttaagcctttgaaaaagattgaagataccaattggcctacctgccctaagtagatgcttcccacagacttaactggtgaagtgcttgtctaaggtagacagaattttttctttagagaggagcaaacaaaaacccaaaaatactggcgtgttcttttgatgttctatttcccaattgatttccgggttcacactactccacaacatcttactgtcccattgcatcttaaccctctctcctctcccgcccccactttttttttgtctgtttcttctgcttccaccgttgcttctgctctgaagcaatcattttctctcccttcaaccaagggtggaattggcacacagtcaattggcttgggagactgcttactgatctgtcttttttgaacactggaatcttgacactggttatcattttgaggacagcctggtttggatatttatctattaagaggaatccttaattggtgtctttgactggagtatttgaaggagtctttaattgggaggttttaaggcaccagaaaagattcattaggaatgactgacctcatgttatataaatgagaaatatttaccatttgctgtacacgtaattgaagcatgattatacataaaagcatataattaaaaaatgtaaataaatacctaaataaataaatgcctataactagcatggcaaaggattctgatatcagctttcaatctcttttagtagagactggacaaatcagaaaaagaggatttatacctgtcctcctatagattatgctttcttctcccatcatccagttttaattgaatctcctcattgtgctttctttcaatcttgagctgcacaagttgttttctcctgtcagagcttttaatacacattgacaagaattattagtctctatctgcagttgttccaagtgcaggtttgaaataaggagtcgtcatcaatgtgctaacgcgtgctacttttggtatttatacaaagtgcctgctgccagttacttgccacttagaatgtgtttttcttttcctctcttgcgttgtgggagtagaaggattctctgtttcttttggcagacagagaaattttcagattggggtctaatgaaagaaataggttccattatacagatgtacagatgttctaaggtcacgatacctcctataatattcttatgtgaaacctcctctttatgttcaacctgtgtacgttacacttatacatagcaggcatagtagccatcaatattagttactttaaaacccaggcctcctaggctgtggtttgtactaaaacatcatattcaaataaaagcattccaatacaaagtggagaaacagggacaggcatggtggcttaagcctgtaatcccaacaggctttgggaggccgaggagggcagatcgcttaatcccaggaggtttagaccagcctggccaacatggcgaaacctgtctctactaaaaatacaaaacttagccgggcatggcggcacatgcctgtaatcccagctgtaatcccaggctgagttatgagaatcacttgaacatgggaggcggaggttgcagtgagccgagatcacgccgctgcactccagctttggtaagcctcggtaacagagtgagactctgtctcaaaaaaaagaaagaaaaaacgtgtagaaagaaagagaggatctgattaagctcacaggaacattgcttctcaaattttaatgtgcatacaaattgtctgggaatcttgttaaaatccagattatgagccagtgggtctaaaatgagacatgatgttctgcatttctaacaggtgatgctaatgctgctaatctgtggaccaaccacactttgagaaggaaggaagtagactattatatttactcattcacttgttccatgataactcttaaaacagactggtgactttaatacaattcagagcaccaaataaagattgtcatatgccttatttttaacctatcgtcttatatcaaaattatctgataaacttcccaagtgtgcatatatattgtcattttaaataggtttcaataaaatgaagattcgtgagtaagaatataggaataaatgacattaaaatctttctttataatttatatttctactttcttttgaaagaatttgtagtggcttaaacataagagcacaagatgagccagtgacaggaaaaaccaagtgcatctgacatcttagcttattaggtctagaagacaacctccattacttggtagcaagcggctgggaatattggtgttcaaagctgtgctttcctgaaggcaaaaacagcatcaaaatatgaaaagctttttacttctggcatgagtgataaagatgccgatctgagaagcaggtgaaaaaacttagcttatgcttctaaaggctaattttatataagtgttcttgtccagctgttcttggtaagtccagctgctagttgaacaggacaggtggtaatccctgttcagtggctcattatcacccagaggctttgatctggctaatacataatcaatcagcttctgaatattaatattcttcctattttcatttcacttgttttacctaaatttattttccaaagttccagtatgtttttgttttttaataagatttttgatcatttatttattttgacataactaggctcatgatatgccagctggagtttattacacccctgaatcacaaactttttttcttccctctttatctccttacaagatccaaattgcaaaacctaaggataaagttctaattttggaagcacaaaagactgaaactattttagaggagagcgttaatgaaaatcaatatctaaaatcctcattttaagactgtgaaccctatagtctatacttctagtgtcttcagagttgtgatatgcatacattaaggactaagaaacatttttttaaatagtcagatttgggagcattagatatgtttgtagagggaaaaatcaatttatgataaaaattactgacaatggtttaatttgtattagttttgcccacttccctgttatctcagaatggcacctccatggacagtggaatggtcctaacagcctaaatatggtaagctttaaaaacagatggcttggggccattctgcttattatatcattgctttcaatagcataactgttcttctccaatggccctctttgttgtttgcttcattactggcacatttctttaatatgtaatctataacattaacatgaaaatggctctcaaatactattactttctccatctgtgacccagtactgtttatcatcatctaatgatcattcttattgcagatggccctctttaaatgtttcagaatagcattttaaagacattgagggtgcttcctacgtacattggcagactgaatgttttaatatcgaaaatctcggtctacacgatgtgtgataaatgactggagatgcaaggcaccagtcagttccaaagcaaggtgtaagagggacaggaggagagtgataaaaaagaatacatactttgcgtgtgtgggtgtgggtgtgtgtgtgtgtgtgtgtgtgtgtgtgtgtgtgtgtttaagccattagatttatctttaaggaagcattatctttaaggaaagttggagtaggaagaacaaaatttaatcaaaagaaacagttcttggccagaggaggtggctaatgccggttatccgaacactttgggaggctgaggtgggagcattgcttgaggccagcagttcaagacctgcctagtcaaggtagcgagacaccccacctctgccaaaaaaaagaagaagaagaagaagaagaagaagaagaagaagaagaagaagaagaaacagttcgttattgcagttcttaaagaaggagtttgtgtttcctttctgatcattcaccatggcagtgatacaaaggagtgatatcaaattgataaatgagttccctaaggctcaacatatactaaatgcctatgctgaacttccaggtttcaagtccctagagcctctctgtctgaagatcctatcaccaaggattctttgtcttcatctagtactttctttctcctctctctattctttcctcatttgcggatgcttgctggggcctgtcaatcaaacatagatgatccctgacttacaatggttggatttaggatttttttacttgataatgctgcaaaagtgatacacattcagtagaaaccatacttcaggtatccacacaacccctctgtttttcactttcagtacagtattcaataaattacatgagctattcaatgctttagtataaaataggctttgtgttagatgattttgcccaactgtaggctaacgtaagtgttctgagtaagtttaaggtaggctaggctgagctatgatgttgagtagattaggtatgttaaatgcatttttgacttagaatattttcaacttatgatgagtttattggtacataacctcattgtaagttgaagagcatctgtatctgggttggagcagaagtattgctagtaatgcatccatgagtcaactgtttgcttaattggtatgctaccacacatgtcttgagcttgttcatcccatggcttgccattgtgttggaaaggaaggtgttacagcattgccgttaataacatttctaaatgggaccaaaaacagtattttctttatctgctagatctttttattttcttctttctctgtatacgtgagctgttcccaaaatttagcacacatgttttatgattctcaacataacgtttatggtccttaacattaatctcatattagaaaataaatcatgatgaaggtgaaatatagaccaagcaggggcagttatgaggaccaaatcgtcagtataaaacttttataattaatattttcatgaattgatagcacttgcttcagagagctaaactcagaaaaaagagaaatattctaacctgaaaatatatttttaaaaactcataatttaaggtagggggcaagtagatttggccatattttgggctttcttcaccaattcagacacgataatgactacatttgtatcctagatttaaatttgctagatggaaaagaaacacataaatataaaccccatctgcgcaaacaaacataaccattcacattcttatgcaggattctggggtaggggagggctttttttgtattataacatagcatgttaatttttaagataaaatggaaatatttttgtgcttttgttaatttttatgttaaaaatgacattttaggcacctaatcaaattctctgagttctttcactaaagaattttgcctaatatttgattaaattcattattattaaagatcaatggaatttctttcagtttgaaaagttgaaaaaatgagttgacacattgattcatagaaaaagttatgaaatttgagaaaaattattgaaccaattttatttaaaatacatatagatattatgtgtatctgccttcattttcaggataatgaatgtcagtgttaaatgtggaaacattctaaaattggaaatcagactccacttggttcaaagaacaccttattttagataagccttttaaaataatgattgaaatccagtcaatccataccctcacacataatcctcatgcatgatctttgtttttccctatctctcctctaaatgtcctttacaaagatgagaaatgttcttcccaacacaaaattcctttgattgtatattagaaagaactgacactttgcagcaaggtttaggaaaagctaacgtaagtagagcttctctgaaaactgttttaccaaaacatactggatttactgctgttaaataatggatttttttttttttactatttatatttgctcctcattgaaacttgtaaatgactttattagtcttaggcaacacatttcattttgcattggataaagatgcttcttcagtaaagtgttcatttatagcattgagaatcttgaaatataaccggtgtcatcaaagggtaggaaggtagaggcacagagaagtgattaatcacttttccctccaatgaatgatctactgtcaagttcaataatcatatttcatctataaagagcactttgagcaaagcctgttttgcacacgtcattacatttgattacaattaagtataaatatatgcctattatttagctctagttaaaatctgcaaaaatatagaaggcttgtgggtgatgtaaattggagatttgcataggtttagggtacaatattagaaaacactgtagttttatttttgctttatgactaaaaggcactagctatgttatctcgtttgttcaccaaactaaaaaacaacagctaaaaagcaatgtaacaaatttcctctaaccttcttaacccatccactgctgtcgcatgactctcacaaatcagaaataaagaaccatttctctactgaaggtcatcaactcatttgagggccatagatcagtaaaaaataacttagtctgagacattcaaatcacttgctttttaggtaaatattttggcttttaaaatgacacaaatctgaccaaaatgttactcagctttatgggaacgggattcttttctagataatcttagggacgatcttaactcatattgtttttgttcagagactaggtctaatttgttagaagtgctgccatgggatctcattctactcaacaggagtgcattcttcttatccagtatccactaaaagtcactcctcctcccatgaaaagagttgccagtggaaaactcagagaaaacatgggaagggattggtgatgtcatataaggagattagaaaacatttttttaacgtttaaaaagtaaagagatgaattttaaaatttacaaaccaataagtttgatgttgatgagcaacaaaatcctggaaaatgacatcgtactgattattaatgattacataggataacatgctgctgggaatcagcgtgatactctcaaaatctgccatgtcacatgcacctcattttcattttttttatggctgcttgatggttagatgagaagactgttagagacagcataacttaggattttacaccacatttttcaagttctcttttgagaatattgggtacaagataaagaacagtggggctggctaataggctgaatttgaagctgattaaataatgacatctaaagaatgtcaattaatagatctagatcaacacaaaatagagtctctgtcgttggccctgcctttgcacatggctgtttcttcttcagtcatctcttaagctcaactcagccctctgcctgaagacctcatttggccagttttgcccattcattactactgtgaactctcttttgttatttttttcctgttttattctgagaatggattgagctagatatgtggaagttatgggaaagcatattttaactaaatattaaagaaacttttgtaatcgagctctccaaaaaataaaatccgccactttgaaaagcattaaactccctgtacagtagattttcaagactgaaatgactgtctcacccctaaaggcaatttctgtattggatgagaggatataattcattaacctttaaggtcacttgtgaatctaatgttttgatattttcggaattaatcagaagggaactgacagcatgacctgaatctgtcctatatttatgtaaacatcctgtgtgatgcacctcattctttgtgcagttgtatgcatttttgaatgttaaatttgattttagggcaaacgcttttttaaaaaaattttaaaataaactttattaaataaaaatttacacacagtaaactgcctccatttaaagtggttcagcgatttttggcagatgtgtacttgtgaaaccaccactgcagtcaaatgacagaacgttcttactcccccaaaagcctccttgtgcccctttgcaggtcatttttcctttcacccctgattctaggcaaccactgatcgtctttctctcactgtgtattactttgcattttcaagaattttctataaatagaatcatacagtatttttgtatgtatctggtctcttatattcagcataatgattttgtttccagcttgaggatattatgaataagactgctaaaaattgtatacttgtttttctaaataccccttataaaatcttacttttgagaagcatattactaaaataacttcccaggttatatgtgtatttgttctttctgttcatttcagcattatcttattaacaagcaactggaggacatgcaccaaggataaattgactaggtgctaactgaatttgtgagaaaggcctagtttctaacgttctttcttgggagcagatgtgtaacagctacttttgctgtataacagaccaaccccaaaacttactggcttaacactgaggtcagcaaacattttctgtaaaggacaacatagtaaacactataggctttgtggagcactttgcatctttgttgcacattctttttctttttacaactctaaaaatgtagtcatacttagctgagaggctgtacagaagcaggccatagaccaaatttgaacaatagttcataaactctataacacaatggccagccatttacttagctcactatttgatgggtggattgggccatttatgtggtgtgaccagttgtactactgtttgccaggcatgcttatgcatctgtagtcagctggcagctggataagctatcgtgacctgactcatatgtctgatggttgacaggctgtcatctaggaacagatgcaactaggtttgtgtgtatctcatcatccaacatgctagttcaggctagttcacatggaaacttctcaggtttctgcttgtgtcatgtttggtagtgtccattagccgaagcaagtcatgtcatagggccatcccagatgtaaggagtggggaaagactccacctgttggtgggaagagatacaaaggcacactgcaagagctggacaccaaggagagggctagaacttttggccatgttgcaagatatcacaaaatattcaagaaaagttacaggaaggttcctctgtggactaaattctcttctgaatttagatgtaggtaaaatggagtgtgctgttaaaattcatgctttgtgagtaatcattgctaggctaaactgtttgtggcttcacagccaatggtagacatacagcatccataatctagtgcttttaaaaatataagaaatactgattacaaacatagttaaccacttattagtactgggaatttaatgaaagctgctgtgattaaatactgaaaaaagaaagattgtgggtttccttctggtaactttcaaagctggtcactcttttgaaaggaattttattcttaaagctgttatttttactcataatatgcttaatacccccatggctgcagactgtctaaaatgttcctacaattatatgagaatacttttaaaaatcatgataattatcagtcttcatggacacttattcagattaatttccccaagcacttaataggatgaatttataagcattaaatagaatggggaccatccagccctaaaatgtgaccattctgtcaggcacacacttgccaatttgttggcgtggacctgagcacactagcaaggactttgaattaggtctcactgcaagatggaagcagaagggcatttctcagtttatgttttgaagtgttttgttcagacaggcaacgtgcagttgtgtatagtagtgtgagctacctgttactccccttaacaatacttttagcagcaatgtttttcctcctgcaatgtgacaatatcaccatgccatttggaagaaaacaaaaaggctgagtgattcctggtatactcccaaacagccacccaaacgaacagctggcagagaagacaccccctaaaacttggagcagattctcagcccctgcagcatctcatgtggttagaacttcagacttgatgaacgcctccccaacttgctccccctcctgaatcttttaatcctcctccagtctcttgtaatgttccagcccttaccagggaataagactgcaaactgtcttccgtcaacttctttccaaatcctagtctagagaaattataatgatgcatgattgtccagtgggcatgtatagtttgtccatttctttatgtagtaaagcctgtagctttcatcttttttgccaatccactataaaaattaattttatatgtcatcctggtacacacacacacgcacacacgcatctatatctgtaaatctttttctgtctattcatgcttgtatgattgaaagaaaagtttcacaaaacattacttacccataccaaatagtacactttcatattttttttttttttttaatttcaacttctattttagatacaggaggtacatgtacaggtttgttacatgggaacattgcatgatgctaaggtgtggggctcatgacctgttacccagattgtgagcatagtacccaataggtagttttataacccattttccccactccaacctctacactgtcatattttctattcttttctgtttcattaagaacaatactggtaatgatccactatatagatttcatgacgtactaagggttcatgacctgcagtttgaaaaacactgtagttagttttatctccacctcaggccaggtcatcagaaagctgcattcttagaccactttgccttggcccccataagattgcctcaactcaggtgtacctcggcatcatgttcctggcttatgtcgaggggcactgaaaactgctgaagggatttttctgaaagtcgacaccatgcagtgtctcccaccttagatcccatgcagatctgtttattcaatctaagtcattccagacttggattttcctttgtttcacttacactctttcctccttatcaataatccaaataataaaatcgatcatatttccttttatattttttcttttgctttgacatctacaaaggccacaaccaaattatacccaccttttaaaacacttttttactgaaatatattaggcatgtagaaaataagggagatgctggttaaaggatatgaaacttcggttaggaggaataagttcaagagctctattgtacaccatggtgactataggtaatgaaaatctagtatagtcttgaaaattgctaagagagtagatttaagtattatcaccataagaaatgataagtatatgaggtaatgcatatgttacttagcttggtttagccattccacagtgtatacatatttcaaaacatgttatacatgataaagatatacaatttttatttgtcaattaaaaaaaaagaaaaaatggcttaaacttatacagttcagtgaattttcacaatctgaacacactcatttaaccagcatccaaataaagaaacagaacattaccaacctttagaaggccctttgtgtgcccttctgatagttacctgtcctccaagggtaaccacaatcttgattttgaacaccattaaatattctggcctgttcttgtcctttatataaatgaaattgcacagcatgtactcttttgtgtctgacttctttaaacctggattcatccatgctgttgtatgaagtggtggattgttcattctaattgctatgtaatatcccattgtgtcaatatcctgcagtatattatatactctactgtggatgggcatttggtagaaaaaaatgatgttataaacattctaagacatgccatttgatgaatatatgtatgcattcctttgaggactatatcaaggggtagaatttctgggttatagggtctgtgtgtgttcagcttctgtacattcttccaaacagttttccaatgtggttgtaccagtttgcactcctactaacagagcatgagagttgtagttgctccacatcctttctaaccctgtgttgtttgtcttgctcattctggtgggtatgcatagcaaaattttcataaccacatcatgcactgtgatcttcaaagctgtgttctggctgggcatggtggctcacacctgtaatccctacactttgggaggccaaggtgggctgatcactagaggtcaggagttcgacaccagcccggccaacatggtgaaaccccgtctctaccaaaaatacaaaaaaattagccgggcgtggtggcaggcacctgtaatcccagctacttgggaggctgaggcacgagaattgcttgaagctgggaggcagagtttgcagtgagccgagatcgtgccactgctctccgacctgggtgacagagtgagactccgtctcaaaacaaaaaacaaaaaacaaatctgtgttctaaattttcctcgcttcttaaagttttatgctatttatatttccttagtgctgggttttattaatttttaagagttatacattgttataagttgccctaaagcctttacagaacaatgcacagtataaatatgtacatagtatatacacaaatatgaatccatgaatgcacagctaatagggccattatcaaaaatcctacacttttccttttcctctagccctcacattcaattggctcaaaagtagcattgattttattctataacctgtcatgaattcagcctctccacaaattcccagtgctcctttcttagttcagactttcatccactcttaactgggctgttgtcatcatctacttggcatacatttccattctgatccctaccctcttttccacccttgtttcttcccacctcaaatttaattctattttaaaaagaaagatattcaaaagtacaggtggtgccaattttttcttctctatccatcatatgcaaagaggcttccaattctttgtcgacctgtttctaagggatgagagtaggtcaagctgtgaggacttcaattcccacgtgaaggtcttgttcatattaactcaataatgtgctttgatgtcctaatggggaaagtagtattttctgccagttagccttcccaagatatcaaatccaatattggccaaatacatttttgaattcctaaaaagcctaaactgatgtcgtaacacagctgtatattaacataaaaactctgtaccttagtaaattattaatatgagcgattagctcacagagtcaatgtaagaaacttgtttcaactcttcatattctagcaaaaagaacacacacacacacacacacacacacacacacacacacacacaaaacctgatttaagaactaactaggtgattaaagcctacttagtttttaattgaagtgcatattctctaatcccaagaggccaaactaatcacctttccctttttgctgctttttttctctctatttctgtaattattataatctgtctgatactgtgtttagctatatatgggtctatcttctctcattagatcataagctccttaaggaaaaggccatatttccttgggatcccacttaaaaaaaaactggattacaatgttgaaatttttatatatttccatgtcattctccaaacactccccagtttttaccaaccataaagaaaaaatgagaagagtttaaatgataagcaaatacatatgtaagtgttccataaatacactatgtttgaagttatttaaagaacttaatataggataatatttaatagagaaacttagtctagatagagcacataaaaaacattcttggaaatttgtggataaataaaagttccttgcatctgtattttcctttcatcttgaaaacatgccttgacaaaagtaagccagagctggagtacaagattcagacattggtagatcattaattggttaaactggattttatcttatttccccttttatggatccctgtctttgtgtggaattcctgccacttgctggctgttcaaggcttgccaccaggagactttctccatcaagctaggggatatttctccctcactgtcccccaccaaatcaatattcacttgctctctgactactccaggtttctgctgtctgagaatatgaacatggatataccttttaacatgcgtgaatactattcatattttaatctcggccccactgaatgatagcaaacgctgtgaattttatgcctatctcaggctacagctagtgccttatcttgcacacacacaaaaaaaatcttacttttcctacttgcttccttcttaagtgtaaaaagcaaaaagaggaaaggtgccttttgtaaactgctaaagagcagtttacagaagagcagtttactaaactcagacctctcattttccctcacacgacaatctaaaacagaatgttaaagtgaatttatttggttctgtatacctaactattcctgaacatactgagttctcttttaagaaatcatacctgcctgacaggctgctttgcatgaacacagcattccccagccttcaaattgctgtcagagccgttgtgtcattttgacccacaatatggcagtattatccacattctatagatgagttaacaaaagcttccaagtggttaagtgacttgcctgtaaagggttaagtgacccacctctaaggggtagaattggtctggacactctgcccctctatcttcatgcctttgctataatacacagctacgcttgctgaagattaaggaagctgcttttgataaagcgtgattcttgtagatattcatctcaggaaaaaaaaaaagaaaaacgctggtgtcttcatctgtagcatttgattattacattttccttatctgtttcaacttaggatgacttccttgttcgcttaattgactggtaattcctttgtttacttttttccaaatctcaagaagcaagtctagagtattaacaatggttacattagcatttaaaatttttttttgaaatttgagtatttcagaaaggggtaatttaggcaggcatgtatgtagaactttgcattttaattaaaaagactcaaaatgaaatgaacctctgacagtaacagatgactacttctaaaagctgcattactacttgatatatgctcagtattttcttgtgggtaagtcctacgacttgtttcaagaaaagtgacaggactaaaacaattaaaaaagacaaagctgctgttttttaatcatatgttcataaataaaactaggttgtgaattgtttccagagaagcaattgacaaagtatgagtaaatcactctaagaactaaagctgcgttgattttttttaatgttcaaccaaacatctatccttgtccaatgatgaattttctttgacaaataaatatttacaaagtatgaaatatagactctgtgcctttcctaaggccaaagcatactgtttaaactaaaatttaattttttttctcacctcaaatacaccaaaataagaacataactaaaaattaattctctcttgtagtagactgtccattaatcttttgttagataatattagcattgtgagtgtcaggtagaaagaaaaactgtaatttctagattgatcagaaaatgtgagtatttatggatttgaagaaaacaataaagtctgataaaatagaattttctgtaacctcccttatggagtcaagaaggaggaatctttcaacatcctcccattttgcagtgaaaagtcttcatgcagtaaatagtttgcttgggtagatcaaagggttaatttacttctgatttgagaagagacgcagacttccctgatttttttacaaaaatgtgttgtgtgggaggaaggtagaggcctcagaatgaattcactaattggggttttcacctgctgtgagtctaatcgaatacaaagccttatttgtagctgaagaggaagagagattatgcagagtgtaagaatttctgcccagttttgaaattccgcttatttggcacaatcggtggggaaaggcagacaaatagttacaagtttgagctgttaaggtagaccaggaatgctgtagtcagatatacttgaaccacattaaccagtgatccatttttagcaggaggtggtgtgggtcatatacatgggttatcgctatagctggcaggctaataggtactccaaattctttcccatgaagcaaccgtcggcctgtgaggttaatgaagtatggctttattttagtgaagatgctaaaattcacatctttttagatgttcggcttgatataggtggctctgtgaagctttgagaaatcttattaaaagaaaactgtgtgagagtgaagcagagctcgactttatctggaacctgtctggtgaaatctctggtttagatggcagctggctcacagagaactttcctgagtctggcttactctgcctccctaaagagacagggcctggaaaaataggcttttgtgtgggtgtgaagtgctctgtgtctgaacttagaggcctcttcatttgctggttaatgtgacctggctggatattcttacatccagaagatgttggtttcagattgatctagggggattgttatatatatatttcaattagtatgctataatatttgccctaaccagcaatgattcaccatacaccaacccatttgttagatgtctgagtcactgttcatggttagtacttgtactatgcaaagaggaatatggaattcttatgtctttattgtatacccaaatgctgacattttactatagaatatgtattcgagttaattgaagtgatacctatactctaaatgaatttttataaagtgatgcaggttatactaaaacttagggcgcactatagatagagagaagctgaaccctaggagttggtgaagtctctcgggaccatccctccaggcaagtacccagttcaaaccattccttgtctttgtcctttcctatgccactctgcatttttacacagctagcatcaggccaacattgaaaccacatgcaacccagaaaggaaaaagatgtgtttgtggaaggtaggaacagcctagtttcagctgttggcccttcacagcctccactagatgggctcattcgaacccaagacccttccaacagtacactgcaaatccatagctccaattcagacatcttccctctgagctcaagactcagatgtccaactgtctcttggatacctgcacttttacatcaccacctccaattcattatgttcaagactggattcatcatctctttcctaaccctcttctgccccctcctcctgaaattcctagctcggagaatgctactcatccaatctttgttgtcactcaaggacaatggtccttaaccttcactgcatattagaatcacttggagagtcttagaaatcctaatgtccaagaccaattaaattagaatctcagggtggtgagacccaaacatctaaatttattaacaatccctgagtgattccaaagggcggccaagcttgaggactattgctttacttcttccctctcttccattcatacatccagtcagtcaagactcctgtagttggaaccttattgtatcatttctccacctcctctgccactgctgtaattcagatcctcctcatactgcaatctccttgtacctgatgtctgaatttcagactcttgtcttctgatcaagcccccataccattgcctgagtgatttttctaaaagacaaaccggacagagccacactcatgctttaattctttcttccttaaaaagctccctcatacctttcaggatacaagtcaaactccagattgtcacactaagccctttccagtttgcccatttctctaacccttatcttgacattctctccaaaagatcaagcagaccgttgaagctcttgtaaagaacaagctggttgcatcctttttaccctcacatctgctgttgtcaccatcataattgttgatatgcctttaccctcaaaaggccagaagctctttgtgggcctacagaggaggcttctctgaatatttatccaatgactgagtctcatctgctttttagccccagagtggggggatctgactttctcctctatcagtagtccccactcagcatcaagtctattgccccagagggtggctttggctggatgggtctcagtttggtcagggtcctgggagaaacagatggtacattcaaacggaacacttgaagagagtataatgaaaaggctatttacaaggctctaggcaggctaggagaaaaaaaaaaaaacaaggaatggtaaacttttgcccaaagggataaagggaggaatggtttgcgtaactggtggaatgctattgctgtaggaaaggactggccaacaagacttgtggctgcaggtcaaggaactcagcagctgccaggccagagatcagtaggagggaacctgaagaataaatacccaaacatcaccttcctcctgtcctttcctctccttctgtaggcctttcatcactgcctcccaattggctgaaagcaaaaggaagccaaacggcaggaaagcctgattgatgtccccacagaggtccaacctcctgggccacagagcagaatggagaaggacaaagaatagagatggatgggagaatggggaagcatcctgcacagtcccttaggtcagagatgcccttattctctaaagataccctcaaagtttaagtggttcaaagaccagagttttggctacgggaaaatgtactgggtcgccttctttgacctcatcccatttcatttcttctttatctctatttctagcaaatttactcttctctgctctgagccatcagtgagattgtctatgagtatactagaaaaaacacagacctttctcacaggaaaagaagccatgtctcttcatggcagcatagcagaatagctaagcgcatgagtcttcgagctggattccccaattccaatccttgcaccattctagacagtggtactgggaacaagtaggtcatggctgattctgaagtcaaaattttagctgaagtttgttctggtagcagagcttcaggctcttttcatgtccgtggttcatatcaaaacagtaataataataataataatataatcagaaggaggagaagaagaaacatctactataaacaaacaatatattatcatacatggcatcactacataatttacatatgacacgaaggtatatcaattatgttcttttccaaatgctttcctctaataagcaaaattcataatctgactgcaattgaacaacaaaacagtctctgtgatgcccgcgtcatttcttaatactttcagtatttaattataatatgacgtcaagatttgggaacaagtcttcaagtgcctataactccagtctaaaaaagaacttaaagatgtatttttgaggattgccatctgtcaatttttttaaaaagtctgaatagtgatttcttattccattcttttttcttgtcaacagattattcttagtagttttctaattggacactgagaaaagagacttaagcatttatagagaagcgtgtcagaactcctgaattttgagcaggtaatttaaaagtgtaaaacaaacaaacaaaaaacaggaaaggaagagagtgacaaatgtcttactatccaggtgttacaaatccttagtttatcgatttgtaatatttacaaatgtccatgctctgaggcttctgtcttttcgttgaaataaacataaacagtagttaagtgatttgccacactgacacagagattggtgtctctgatttactgcaaagggcactacttcctcattacaggacactaatccctcttccccaaggatcggagcagacctagaatatactattagaccaagggacaacttcagccaaagcaaatcttagtgtgcccccctcagaccgtaatagcagctgcctccacaactcactagcttaaaattgctaaagggcaacactaagtaatctcagtgtatgagccagaatgccagaagaagtgccatatttgcttaaaaatagcaataccgatcatacttacatgcacatatctttagtgataacatttacctttatatttggtttgttaaaggtaataaagaatcctggcattcccttttgcttttgtccagatactttatttttgcctcttttgccatgctatagcattagataaagcaaaacgggtgtgcttccacctaaaacattctagggggaaaaatgttgagcagaaaaggattatttcaaaagaagccggatatggtggcatgcacctgtcatcgcaggcacttggaggctgaagtgggaggattgcttgagcccaggagttgggagaccagcctgggcaacacagtgagacccccatcccttaagaaataaattttaaaaaggggaccacatttaaactgtagaccgaagtggaatgaatcaatcggaaaggagagtggaaagcaaatgtttgaaagaaaataaaaagaaaagcaagccaacaaaataaatggacaaagaagggcagtgaaaatatcactaacagtttatcgtaagatgctctttggatgctaatctaaggtgttatgtgaagtttgcagaaaattcttgtgctaatgaaggctttcttcttcttttgagtatttccaagcttgaaataattgtgtgtagttaacttctatcatcatactgcaaactctaaaattagaattatttgaactgttcaggccctgtaacttttccaataaaatattctattagaaacaagttccttctagatcttcctaaaagaatactaaaggaccaaaccgtgcaacagcactggtggtattgtcttaatttagagagtccataccagtgattctcaaacattagtatgctcagagtttctggttcaataggtctgggccgggcccagggaattttcatttctaagaagttcgcaggtgatactgataactgctgttcccagggtctacattttgagatccgctgctatgtcacaaatccaaatccaaagtctttttaacaatcccttttagcccaggatgagcctaacggcaatttcacgtccttatcgccggccactttaatcttcaactgaggaggaagggagagtgagaattatgtatataatttttttcttttattttttaaaaagaaaactccaagcccacactcttaattatctgggatgaggtcatttgcacctgggtcatttatttagacaacaagtagtcttgctagaggctttaaggaggtgttagcagagcggtgtgtggcttccaggttcctgggtctaccttaaatccccatcctctttctttctttctttctttctttctttctcttttctttttcctttccgttttgaaagccccaactgcccagtctctgggtgtccgggttcccaggtccctaggtgggggcggagcccgacacggccccgccccgtctgcccgcagcgccccctccccggcccgcccgcgccggctcctccgcagtgctttcagctgtgagcttgggcggcggcggcggcggcgctccactttcggggagcccggcggctctgggaagctcactcctccactcgtacccacactcgaccgcggagcccttgcagccatgagggaacagctcaaagggtaagtggatcgcggccccggccccgtctgatggccgcaatccgtgcacttgtggcgcgagcagggggcaagctgaggcggtcaaaacttggacaggcgcggcggctggacccggggcgccgggcggctgggcgtctaggaacctctcccgcgggttcccgcggcgcggctgcaggtgcgcccccggggtttctccccaggcgccgggctagtgggggaacctcttccctcggctttgggacgggctcggagagaaaaagctgatttctccccgtccccagaggggataacgcgttcctcacgcggggattggggccgggggagcttttcactcctttccaggctgccagtgtggacgtgagcaaggctggctgttcctaaatcgtcgctcttactcgtagaaggaaggggcgcacgcggcgctaccttccattgcactgcaagtgccaaaaggtcaactttctgcctgatttcttccgaggattccaactgacatttccctcgctgcattttctaccgtgctcattccatgccccaagacctgcagaaatcaggaaagaaagaacaaacaactaaagcccagaagtcaaagatttcagggggtggggatttttgtttgtttgggcttttttttttttttttttttttttgcccttcgggattgggtgtggagtcatttctagggtgttctctcgcatttctccaggtgtctgtgctcatcttcaagcaaagtttgtcactcccaatcccagcacggcaataaaaagggcagaacactttgcttatattagtcaaatttgaagttaagtttgaagctttaaattgaaggggtttagttgctcgagggaggcataatattaattataaactgtttttacatcatgaaaaaaatccatccgatttaagtggtgaacttttaagtggcgtctttaagtgaaatctacatttttccttgggcaataaactcttcttggtcttctgctttatccctgtcatctctccttgtcacccaccccccccccccccacacccccaatcaacctttctttttttgcctagcttttttattgccttttactcaagcccctctttggaggatacatttgctgttggagaagcgagtggagcaaatgaagcaacacggttatatgaaaggtctctgacccttgaacaccgtggaattggtttcagtcatcattgtttgatctccgattggacacgaccctgaaaagaaattgctttgaccaaagttgagggtgggtaggagttaaaccttgaaaagcaaataaaacggaggacaactaacagctggaacagccaccgaggcaatcatctttgccctggctttagccagacagaataaaatggtaaatatcccagggaacaagaaatggggaactagaatggatttctgatgcttatattgatgcccacccctccaaacccctgccccacggtagcagaaactttaaaatatattttaccatccacaccctgccagtattccagcaatgcaagccaagttcaacaattcagcacgcaaatgccaaggttcctctagaaaaagagtctgatcctcagattaaagggaaatcatttgtgtgtgtggatcaatgggctccagattatatatgaaaccaaactctaatcctctgcaaatcgcaagagaacgctccctttttatattgctgcatagcgattagttttctccctgggaagtagtggacagatagttttttaaaaaggcaactgtttggaatattttcagtaccaaataacaatggtggcagaagaaatcttattttaattaggcaactgccattttcccagccacagcagtagatatttgttactttttataagtgtttaatgtttgtttttaagaaactaaaaaagcaattccaataagtctgattattccagcactgacagcaggaacagctctgaggcagttataataaccttgcacactacttgaaactaaagcaggtgagagaaaatttaaattgtatggtaggaaattaggtcagccttgtgctcagtagagtaatgctttaatttcttattattgacaagtaggtgttgctggggtcttttgtcatagtcgatgactttatattttaatttgcatcagggtcctatcaccgcctcaaataaaagggaaaaagattatcatggtttgtagaaagaagaaggagaggggaaatcttcgtataaatactgctcagagaggcatatctgatgccaggctttggaaccagcagggccaaaatcaataacattttttaaagatgtaaagagcgttttaaggattatttatgaagctgatctctgtgttaatgtacgtacagacttgtgatctatgttgaacattgttgttctcagaaaggccaaacaaagatgtacccattaacatgtgaacaggtttcagaatttcccttttggttgttcatggtatatggggagtgtatttccgatgtggagagtgaaatgcagaaaagagacaattaccaaaacagtgccacccacccttccactccctcctccctagcacaccgtgtttttctatatcgtctgcatattccaggtaaatgtgggctcttctcatggagttactgagaattctctactgttttagaaggcaggcacagagtaagaaacgaagctgtaaaatcggtattgatcacagacaaaaatgtggtttgtccttcaaggtacaagatagatatgagttatgcagatttgtgcttacagtttcatccagtccatattcatagttcctatctattttggagggttaaatgtgtcccagtggggctctggattcatcacaggtagaaaataacaagccgtgaagtgaatatttggttcgtcatatagttaccaaagaatctgaaggttttttggctacgttgccaagcatttttagcattaaatgattaaaagactatttttctcgttttaagaattagtcacaccctttattcttttcttctttccacttgtgctcacttcttttgcttagaactgatttgcaattgaagtgaaactaagactgcaaaggtgaaatctaaatctgtttttctagttcttttgcattgcttagaaataaaaggtttgtgtgttgaaggtgagaaaggttagcttctggaattgtttgaggagttcatttatctatgttattcaagtcccccagaatcacagataactgggagaatagtacctatcaaggactagtatcttaactcacaaatgggcaatggaattgggggcttagaatttcctccttcttccagtaaaggagattttcagttttgccgaggactgatggattaaaaaaaaataatttctaaaacccttttcataattttaaccttcaaaataaattctttaaaaaggcaggaatgtatgtatgccaacagtcatgaaatttctttagaagatggggagctccatgaagccctcattcattctatgtgggattctcctgtaaattgtacacactgtttccctttccttttagaactgtgtttggtacaggtttatttcttgcctatgttcctctaatttgaagtccattccagatggtggcttttcaccgtggttccctgtctctgtctgatcaggcttatcagctcagctaaatgtttttctgcagacctatagaagatgctacggtccttacaaatatcctggagatgggacattgttgttacacagtgtgactagtaagggcctgtgtgagcccttgtacatgtgggcacacatgtgtgtgcttcctctcttcgctcttcctttctccctggtgcttatatcacatctggatgacctttggaaatagaggaggcctgaatgcagggtggtctcaatagaaggtaacctttccttgctctgcacttatatatggaattggtatacactcactttccgagctgagaaatgcctgagaacaagcaacactttttccacgaagctgcaagctgcagcctccttgtgctgtgcatgtaaagtaccagtcctgcctaccccttctccagatcataaaccggcttggtcatggggtgtcctaaaaccccttaaagcatagagaccatatctcctgctcttcttgctctttaagacttgaatgtcactctgttatattccctcaactgataagcccttgttatagtcctcaaatgtgagttgtctctatggaaaagtaaaactgaaataaacgtatttggaagacagtgaaacagcacttcacaagtgaacattttcttgcaaattgatttcagtagccctcactgttcaatcactgactagtaaatattacagggatggtctttgaagttgtacagtttggatgatttccatatgtctttatgaggtttatgattgtgttccatttcttaaaccaacttaaacggttgttttaacttattttttttaaacataggtgataacatgtagtgtgttggttttgctctctaggaagggtctttcttcgccttgattgacttaattacagttggatccacatctatattgtaatcaactaataacagatttgcttttaatagatgacaatttgaggggcacatgataccaaaagcgaccacatattgagcaccaaatggtgccggtcacttacctatttcaactaatcctttaaccctccaaggtaggcaggcttgctttaaatttcaccgccagtagggcgcagagccctaaaattcaaaacatacgctaaggccattcgacattgttgcctctccagactcctctttctgtgtgaggcccctgtactttctggtcctctggaaatgccccagtttaagcgatttctcttttttccttccctccccttcccctcaaaagtttatgaataggctctgcatatgagtacccaaatatcattcagaactgcattttactgtatcaaagcctgtcatgcaatccctgaaaactggaaatatgacgctatggtgatttatgtagatgggccaaagtaaggaaaagtatatgtagttatttctccagggtttattcatgtaattgaatgaggaacaaaggtgttttgttctttttgtggcaggagctgatagccagcaaccacacttcaagaaatggaagacagctgtgaatgcttcattcaggcccaagtaaatataggaagaggtgtagtggtgtatagcgtactgcgtttaaagaaaaaacactctgaaataatgggaagaaggaagttatgatatattagtcaggcagtagatataccttaagctgaaatgaaatacaggtatcatggatatgagatctgtatatgtagaggaaagagtaatggaaaaatgtcaggggcagtgaaagcaaatgagaagtgagatgatttatatttattgaactaatgtccggtatctctttgacagagttgaataataatcagttgtcggtgtcctttctgtagtgttccacattggatgggtgaagaagtcctgatagtcgattattgatcacataacaaggtcaatttatcataactgaagtgcgatcgatttgtgggtgcaaagaagaaacaaattctggaaccgaataatgtttatattgcttttctctttggaaacaaagcagaaaggggcctttctgcttgtaagataaacatttcttcaatacactatggaagcgctttgaaataaagattccgaatggttcaaaagcaaaaatcatgttgttgttattgttgttttcttttttcctgttttcttgactactcattgtaaatgctaaagtctttctttatgttttgtgttttagccacgagactcaaacaacttgctgggaccatcccaaaatgacagagctctaccagtctttaggtaaggacatggccatgtttcctccaagttaaatgacaggtgacctttaggataaagtagtttgcagtgtgaaagttacttgctatataaatacatcactagattgtttcaagggtgaaagcagtggcaccttcctatccaaaattgacagtcagctttctttttatcagaggttccttaaaaacaagttttagaagttgattgattcctaaaaattcaatatacctgagagggcctataggtctttgtagttctctttggtgcctaaaatgatggaaaaacagttgcaatttatggctatttttttttttcttcccacgaagatagaaaactgtttcaggtgcttgttgatttcttccgtgtgaaaccaagacaacccttttgccaaaccacaaatgttgtgtaaaggaattttctgccgtctttccggtgctcacaattcctaaggcctggcgggtcattaatgtgaacatttaaatgatttctttagtatggcttgttttgtgtttatgtaagagcctgacagttctgttttctttcccctcataacttgaattattttgaatgggtacagagcatacaaataagggtttgaaaacaccagtctttttacactggacaaatgtccagatgtctggtttgtcgttttagatctacaaggaatattctgaaatgagttatcttaagttgcagcttgttttgggttttgttttgggacagggtcttgctctgtctcccaggctggagtgcagtggtgcggttatagcttattgcagcctcgaacccctgggctcatggcggttcttctgcctcagcctcctgagtagctgggacaacaggaatgcaccaccacacccagctcatttttaaaatttatttttatttatttttgtagagatgggtctcactatgttgcccaggctgtgtttttatgtatttttttaatataaaaacgtcatgtcttttctactttttcaagcctgcatttctgtgaatggacatattgatagaaaaacacataaggcgatctctttggatttaaggttatgtgatgaacactgtgggaatcagggtacttaaacataaattctgtgtaggtatacgtaagtggggtgtgtgtgtgtcagggggtacgtagctattactgcttttgtgtcatagattctcacaaaatgaattgcagctatagagacaccaaggactagagaagagatattagccaaaaaatggttttattaaacatttttctaattataaatgattaaatgtcttctagaaaacctgaaaaatgtaaataaaaaacatgaaaaaggaaaaacaaagtcacttatactagccagagagatccaatacatttcgagtaatattatgtcatttcagtctggttataagtgtgtaaacgtttaaaattttaaataaaattgggatcagctaattttcaagtgctacatttccagcccctacagaatgtttttggcttataattgtggactgtttataccacaggtggaaaacgtgaatgcttatcttttggcaaatgagagaatgaaaaggcttcatctgaagtgggcagcagctgtcctgggcaagctggtctttctatcccagtactcccaggacccctgattgtacaagagaaaaactagaaatctgtccacaaagagctaatttaaattagtctgtgggcctcctgatcgtaacctgtggtttacacagatttagcccacttctaacatttcctactctaattacagtaatttctagttgtaatattttaattcactcttattttaaaatcattattattatagaattaatacctattcatatttttgaagtttaaaaatatagacaggctaacaataaagaagagacaaatcattcgtaaccccacttcttagagttagctggtgtttaatagtctaggatcttcaaaaatgtctttctatacatatatttttatagaagttgaatcattctgtcttataacttgctttttttttttccactggaaagtaatgtattaccatggccatatttccattttgttgtatagtattctctaccactttcaattactctgtaatgagaaattgcaaacatgtttgatgaaaagctaattatggactatcaatgaatacatgtttgctcctttaatacaaattaaatatacatttaatcattatatttctaaaattttctccatactttagatgtggtgataaactcaaaactgataatctctcatgacttgtgacattgggcttgtgacatcactcaattttgaattataacagaattttacagttgcaggggattttagaactcatttattgcaaactttctcttttatgaaatcaactttcaggtataatttttatataataaaaggaagtcatcgtaagtgtgtgatcaattccagccccctttgaaattctgtttcttgctagcccaataacaaaccacttgcaagtgaactaagtgttgaagtttgcttttcacctttcagagttaatatttccaatagttttgtaacaatcaaacattcgttgggcttttatccaagtggtgattcatcagataacatctcccatttattgcgggcctattgtatgttttccacatgggatgtgccagcaaccaacctgcatggtggatggtatcaacatccacatttcacaggacagcgaagccaggctcagggaggaattgatcagggctacacagctatgtggggctacacctggatttgtcctcagttttctgttagtactttcactgttctcattgattttatttactaggtaaagtatatttatgttggttactacatacctgctacacgtatataggaattgatagttttacctatgaatagtaagttacttgagtggtatttctggaaatggtatggtgggtcctaaacaatgggcactcctttcactgttgcctggcacatatagaatgattgttatatggctacatccttttttgtttgtttgttttttgagacagattctcactctgtcacccaggctggaatgcagtggcacgatcttggctcacggcaacctccgcctccccaggatgaagtgattctcctgcttcagcctcccgagtagctgggattactaggcacccgccaccatacccagctaatttttgtatttttactagggacggggttttgccatgttggctaggctggtctcgaactcctgacctcaggtgatcctcccaccttggcctcccaaattgttaggattacaagcgtaagccacagcgcccagcctgcctacatccttgagatcccatataagattaactaccagcactgcctttccccctctccaaaattacagtgtttcagagtcgaaacataagcataaaatactgaaaagaaacttttcattgattttagtttttacttattagtttatatttttcttcttcaagaggtatccctttaggtccaaattgctctttgagctggatgaaatggtcggaagccttcaactacagtcagttggtgaaaggtatcttgaaagcagaaatggtgttgtggtctggcgtgtcaaatgtttaagaccacatctagccccctctcctaatcgaacctgaacctcatgtctctggtgaggtgctgaaaatatcaagatgttgctttttccctctgtacccccactccaggcatactctaccgtggaagctacagtggttcacagtatgcatggtaggttacacattcctagagacgcccacttctaaggagatttccattctctaatttgccaaagttcccaagcagcctgttcaacacatgtttatgttacctgccttgccctcaaaagcattcaggtgttcccctgcacccagggtttgaacacaataggattagaaggtgaaaacattttgttagaactgaaaaagtagcaagtatttactgatgaaaagctataatattgcttgagatattaccattggagctctctaatacattctgggtggttttctttttcattccttttccactgattttctacaatgaatttatattatttacagttagatgtttggtaaaaaagtttcttcgtcgatacccccattccatttcttacttagtgtctctatagctacaattcattaactaatgagaacttatgacagaaaagcagcagtagccacacacacacacacacacacacacacacacgccccacatatatgtagataatttatacttaaggaccctgattctcatggactttgtcaggtaactttaaactcaaagagatcatctcatgtatttttagtctgtatgtccagttgtgaaaaatgcagatgtagacattttagtggtagagaaaatagaacttttttgattaaaaaatagataaaaaacaatataagataattaattttagattatttccaacagatctaaaatggctttgcagaggaggtttccatcaagtgttagaaatattgtgtttccctcatttatcggctgtgtacctacacaaaaaattgagagaaaatattgccagagtcctacacaaacaaagcaagacatagtaaagaaataatttaaaggttcactatgatgactgaacagtcattaggaatttgagtccccagaaaattttttacatcacattaatggtttgacaaaagcattgtcttggattttcacagggaataaatcactaaaagcaactggaaatcagttttctttcagcatttgtctgtgactacccccaatagtcatagaatggtagtagagaatagtagtggagtaagtgggatataagagaccaagtgtctcatgtctattttttgtagaccttggtgctttatctttaaaatgtgaggatattggggctgggcacggtggctcacgcctgtaatcccagcactttgggaggtcgaggtgggcggatcacctgagtcaggagatcaagaccttcctggctaacatggtgaaaccccatctttactaaaaaaacaaaaaattagccaggtgtggtggcacatgcctgtaatcccagctactcaagaggccgaggctgaagaatcacttgaacccaggagtcggaggttgcaatgagctgagatcacgctgtagcactccctcctgggcaacaagagtgaaactccatctcaaaaaaaaaaaaaaaaaaaaaaagtaacgatattggacaagtgtctaagatttttgtttttcttttactttgggctgagggtggggcaggctgtttctaaacttgctgtgatcattatttttcaagaggtacctttcggctaactctgcagacaagtggatttctaaaaatgtaatcattcctatgttttaaaatgtacattctgagaaaacaaacaacaggagaagattatgccacccatccgtgtcttacaggctgagtgaggcaagctgttgtcaaatagagaggctcttgagatatttcccattagactcctctgggtcattcatttgttattgagagggtacattcttcgtcactccctagaagtaataatatgtttgattcatgaggtgagttttagatttctattagcatttttacaaatgtaatggaaagactgttccaataggttagcttggtgatttaaaactctgagctcttcaaggctccagaaagcatttacaacatcagtagatgttagatagtaatatgctctggaatttattttgaaatactaatataatattgatttacatgaagtgcaattatgtggttaaaagcctgtccttttctcacaatttatgtctaggtccctaagttcattactgaaattttaagaaaatattttttaaaaagctcaccctgcccccacacacataatatatgctgcttagagatacttttattggggtttttttttttttttttgacagcatcttgctctgtcacatagactggagtgcagtggcctgatcatggctcactgcagctttgaacacccaggctcaagtgaccctcccacctcagccttccaagtagctgggactatagccgtgtgccaccgtgtctggctaatctttttttaaattttttgtagagatggaggtcttaccatgttgcccagcctggtctcaaactcttgggctcaagcgatcctcccaccttggcctcccacagctctgagatcccaagggtgagccactgcacctggccttcacaatttccaatgtcaaatcttactacaaatttaagtaatcaagagtatttacatatggacagatatactgaccaacagagtagaatttaggctgggcacagtggctcacatttgtaatcctagcacttttggaggccgaggcgagcagctcacttgagctcaggagttcaagaccagcctgggcaacgtggtgaaaccccgtctccccatctctacaaaaaatacaaaaattagccgagcatggtggcatgtgcctgtagtcccagatactcaggaggctgaggtgggagggtcgcttgagcccgggaggacgagactgcagtgagccgaggttacatcactgcactccagcctgggcaacagaacgagaccctgtttaaaaacattatttcttagcctgtcttattgggggggggtctcttaattataaatacaataaaatatgtggttccccaatggttcctttttaaattacaatgtgagtttttttgcatttgtgatactgtcagtatagtacaagaagaccagtttatgaaggagacatgtaggtaaaaataggataatgtgaagagagaatcgctgcacttcagaaagctgattttatttcaagcagtttattaaaatctagatgcaccgtatgttctggtgttacttattccaatttccttttccttcattgaagccctcttaaccacaagtgttttctcaaggggtactggttttccttttcttaagttatagcgttcttcagaaggatctagccctttttaatctgttgcccaatttttggatcctactatccagcatgatgctcacctgaatgatgcgaaagctctcaattttcaaaaatggacttctgagtgtttttggaattcttaggaaaagtggtctttaaaaaccataagatttgaaggcagtctatcagcacgtagcccttagcttcatgtctatggtttgcagagagcttcagaatgttaaaatgagggtttaattttagggtctgctgggcctgaggttaggggtgtgattcttcagcagttctagttaggagaactagttaagtcctagttaagtcaatggggctaaaagctttttaaagatacatcaatatcattataaatcagcaatttgcaagagagttaaaaacactgctatcaaaatccttgtacctctttcctcagcttgcccaagaggaagggatattgtagttatttgttcactctcctcttttgataggctttctacattccattaagtattccctcctgaggatgctcttgggttagaaactgcaggattctgaatgactatgaattccttccttttgcattaggagcttgtcctaatgcttttctcagcatattttgtgaactaaactgttctccactaagctactcaatatttagctttccttggctcttgcttctagttccttaatatattgctcagtgttaaaacctctgccttttgactttttactgccataacgctttgaactggaaaggatagctagattcagatgccagctttggtgtgacctcgggcaagtcccttgctttctattggtcttcattttcttatatgtcatgttggccagtgatctttcatcattaaatgactggttttgttttaacccctggctagagtaaagcttggttgtatgaatgttgtcagccctaaacccccagttcctctttgtcaccaccaacctaaaggatatgaataataggataatcatatttattaatttaattttttttttttgagacggagtctcactctgtcgccaggctggagtgcagttgcacgatctcatctcactgcaacctccaccgcccgcgttcaagcgattctcctgcctcagcagcctcccgccaccatgctcagctaatttttgtatttttagtagagacggggtttcaccatgttggccaggatggtctcgatctcttgacctcatgatccacccgcctcggcctcccagagtgctgagattacaggcgtgagccaccgctcctagcctataatcatatttgtaataattgtactttatttgtgtagcactttacaatggcgaagagttttcagaaataaccatatttaatcctcacacagctatagagtaggtggcatatgacctggattttctatcaatttcagtttcagattttttgtcctgtcatccctttgagtgtccttccagtttttgatttgggaaataatgctaccataccggtggatggggcaacttttcccttctttccatttggacttgagcagactgagactcaagacttgatttgatttatactcactatggtagaagataaggaaccaagtccagaacacacattttacaaactccgagttctctgttctcaaaggaacatccattactcttagcatgatttataaaactgctttatcggcataattaaactggaatccatatgacattctttattccctagctgacaaaattagcacaggagatttactcaaatttgttattaaggctgttataaatgttcttcctttactattcagcttataaaagaaaaaagaaaaataatctgctcttttaactttgattaggatccattgactttccccatttgtaaaatagaaatgtaacttccaaatcaaaatttatggcattttaatggactgttctaaatattataatattttttcttgttcaaataacttgatttaaagcttctaattgaagaacataatagatatttctgaattgcatctctccaagcttatttcagaaggaaactcaaaaagaattgttccttagactttgactggtttacagttttaaaagagctgccaaattgtagtttactgatctaaataagaggaacattaaggttacacctgcagctagaagaaaagtgctggatatgtacaattttatgtagctggatctgcagaagatgatttttgcacacagagtaaaggcatctaaaaacgtgtctgctcttattcagacatttccaatatttcttttttaagcccacaagtctgattacctctgtatgtctcttgggagctgcaattttgctggaaagagattcagaacagtcagagcactcacataaaatagatagtttttaaagtctgtaccctctacggtagtaataaaatgacctaaaaatattctgaaagtctctcttatgacatagtggatgaatcattagcttatttatgaattggtgatattctgtgggaatgtttcaaaatttgctattccacaaagcgttcatcgcttgcataactccaggaaagtcattacaccccctcataaatagaagcttatataacggagacaaatgttgcttatattgatatatttacatacagatttctttaccaagcattaattttggtaagaaagtgattgtttttatattttactttcttggtctgtaaagaggctatcactttaaggccaggcatggtggcacgcacctgtagtcccagcgcttccagaggctgaggcagaaggatcccttgagcccaggaatttgagtccagcctgggcaatatagcaagacgttgtcttagaaaaaaaaaaaaagaagctatcactgaagagcagtgcttctcaaactggtgaagggccaggtttttgttggtggtgggtttttttttttgtttttttgagacagagtcttgctctgttgccaggctggagtgcagtggtgcgattttagctcactgcaaactctgcctcccgggttcaagcgattttcctgcctcagcctcccgagtagctgggattacaggtgtgcaccaccacacccagctaatttttgcatttttagtagagacggggtttcaccatgttggctaggatggtctcgatctcttgacctcatgatctgccagcctccgcctcccaaactgctgggattacaggcgtgaaccactgcacccagccgcggtggtggtttttaacatactacacatcacagatttttaggtggtgctaatgaaactgacaagtatgcattcacaccacatgtaactcaacagtcaagttcaacaacacttgacctcgtctgtaccctgctccatgagatgaattcattgatcatgaatttggatgtcatggcaatgtcaaattgctatagaagttacttaacacactgtccatatctatgcttgtgaaagaccatattttgagtagcactgttctagagcacttaatttttgaaagtataaatgtaaactcaaatcaagtgactcaggtcgggggaggataattaaccaaacaggaacacctgaaaatgttatttatgcggtttaatgttttgccagttgagtcaagttcaggcagaggagggatctattttctttcccacttggtagctctccttagcaattgttttagaagacaaagcatagaaatcattgtgttacaggaaggaaccagagattaagcggcagagccactgctgcctagtttaatgtctctcgcaccccctataattaaatataatgtatataatgtgataagtttaaaatacaggtttgcttttatctagaatataaactgtgatatatgcactctttatggggtgcattcagtgggggaactaattgattatactgtgactttcctattgtcactttatgagtttaggtttggaggcaatgttttgcagcaacaaaattgttcattgactttgaggctggatttaaattctgattctgtcaccagttctctgtggtcaaaaaggaagccactaataattttaaacctcagttatgtgatgtattaaatagttatgatgagacttatcttgtgttgtgaggattagaatgacatatgtaaggtaacagaatgtctgatgtagtaactgctcaaggaattataattgctattagtgatatgcattattattattagttattattatcatataccagtgtctctccttatttaataatctattgggttcctgaattgagataccaagaattcagatagtgagagacacctaggtttaggtcttcacatttgacactcaaggagccactaaatttttctgaagtattttacttcttaaccaaggtgataaagatcacctgatcacaatttatcctaacttttggaaagcatacacgtactttaatttgacatgcaaattaaaataatacattttgtactgtgttgtttgccctcccccaattctaaaataatatatcattcaggataaaaaagactacactttgggaggccgaggcaggtggatcacctgaggtcaggagttcgagaccagcctgggcaacacggtgaaaccccatctctactaaaataaaaatttaaaaaagccagaagtggtggcgtctgcctgtagtaccagatactcgggaagctgaggcaggagaattgcttgaacctgggaggcacgggttgcagtgagccaagatcgcaccactgcacttcagcctgggcaacagagtgagactctgtctcaaaaaagagcataaatatctaataaatgatggtggtactagtctgtggtagtggaggtatcacagaatggctgtagagatgaggagggctaaaactgtgaaaagccttatatggtatgttgaaggttttttatactaaggtttttgatttggaagatgtatcaatcagggtctgcctggtcagaaaacataaaccctctagttatttcaaacaaagggaatttaatgcgggaaattggttactcaagaatggaagtgctgagaagccacacacacagcatgaagtttctgttatacctagggctggagggacaatgacaagaggtggtatcaccagagccccagatgtcatgggcatcaaggcggagttggaacctttggccagctgggaccaatgagggaggggctccgagggagctggagccaggaaggagacacagttagccagacctattgccggaggtagaatgaaaaaggaagtacgcccggcttctcctttccgcctgccctctaggcttctgccagtgactcctattggccaaacttacttggaagccaattggtaagggagcaggaaaatgtactgtaataaacagcagagcagagaaaaggcagagaaagtatcaaaaaccaacaagcaaatgattgaagtacaggagatcccatggacagtaaggcaaccaaccctctatgcagatatttcgggaacaagaaacataaaaaaactaaaaagctttcataggagtttgaggtgacatagataagataccagaaggacatcctgggttcaaaggaaactgatcttaaaggagaggaggtagcaattaaaacaaattatctgcagagaagtccaaacactaaggataagcttccatgcatttgatgaaagtacttgcgacgtttacaggtgtttatgctcatgactctcaagactaaatacagacataccttggagattttgcaggttcagttccagaacacttcagtaaagcaaatatcacaataaagtaagtcacacaagtgttttggttttctagtacatataagttatgtttactctataatgtagtctagtaagtgtgcaacagcattatgtcttaaaaaacaatgtacataccttaatttaaaatactttattgttaaaaaagctaacgatcacctgagccttcagccagtaatgatccttttgctggtggagggtcttgcctcgatgttgatggctgcacagcatggtggttgctgaaggttggggtggctgtggcaatttcttaaaataagacaacaatgaagactgccactcagttgactcttccttttgtgaaagatttctctgtagaatgtgatactatctcatgaaaccacttactttgctcatccataagtagcaactccctatccattaaagtttgatcatgaaattgcagcaattcagccatatcttcacgccccacttgtgatttcaattttcttcctgtttccactacatctgcagttacatcctccactgaagtcttgaacccctgacagtcatccatgagggttggaatcaacgtcttccaaactcctggtaatgttgatattttgacgacctcctatcaatcacaaatgttcttaatggcatcaagaatcacttccagagattttttttttttttttttttgagacacagtcttgctatgttgtccaggctggagtgcagtggcgtgatctaggctcactgcaacctctgccttcctgggttcaagtgattcttctgcctcagcttcccgagtagctgggactacaggcgtgtgccactacgcccggctaatttttgtatttttagtagagacggggtttcaccattttggccaggctggtctcaaactcctgacctcatgatccacctgcctcggcctcccaaagtgctgggattacagccgtgagccaccacacctgacttccagagattttccatttactttgcccagatccatcagaggaatcactgtctatgtcaagctatagccttacaaaatatttctcaactaataagagttgaaagtcacaattttttcttaatccttgggctacagaatggatgttgtgtaagcgggcatgaaaacgtgaatctctttgtacatctccatccaagcttttgggtgacaaggtgcattgtcagtgagcagttatattttgaaaggaaacctattttgaacactaggtcttacagtgagcttgaaatattcagtaaaccatgccgtaaacagatacgctgtcatccaagctttgtttttccatttatacagcacaggcaaagtagatttcacataattccttttttttttttccttccaagacggagtcttgctctgtcacccaggctggagtgcagtggtacgatcttggctcactgcaacctccacctcccgggttcaagcaattctcctgcctcagcctcctgagtagctgggattacaggcgtctgccaccacacctggttaatttttgtatttttagtggagacggggtttcaccatgttggccaggctggtctccaactcctgacctcgtgatctgcccgcctcagcctcccaaagtgctgggattacaggcatgagccactgtgcccggcctgatttcacataattcttaagggccctgtgatttcagaatggtagatgagcattggcttcaacttagtcaccagctgcattaggccctactaagagatacagcctgtccattgaagctttgaaggcagtcattgatttctcctctagagctatgaaagtcctagatagtatcacctttaaatagaaggctgtttcatctatgttgaaaatctgttgttcgttgtagccaccttcatccatgaccttagcttcatctggaaaacttggctgcagcttctgcatcaatgcttgctgcttcatcttgcaccttaatgttatggatatggcttgtttccttaagcttcttgaagcaacctctactagcttccaacttttcttctgcagcttcctcatctcttttagccttcatagaattgaagggagttaaggttttgctctggattaggctttggcttaaagaaatgttgtggctagtttgatcttctattcagagcactcaaactttctccatatcaggaataaggctgttttactttcttatcatttgtgtgctcgcagggtagtacttttaatttccttcattaacttttcctttgcattcacaacttgactgtttggcatgagaggcctagctttcagtctgtctcatctttcaacatgctttcctcactaagctcaatcattaatagcttctgatgtaaagtgacagaggtatggctctttcttcccttgaacacttagaggccattgtagggttattaattaccctgattttaatattgttgtgtctcagaacaggaaggccagaggagagggaaagagatgggggaacagctggtcggtggagcagtcagaacacgtatgacgttgatcaattaagtttgccatcttatgtgggtgtggttagttgcaccccaaaacaatttcagtagtaacatcaacgattactgatcacgattcaccataatagatataaaaataatgacaaatttgaaatattgagggaattttcaaaacgagacacagacccaaagtgagcacatgctgctggaaaaatgtccatagacatgctcaacacaggattgccacaaaccttcagtttgtaaacaatgcaattttcacaaagtgcaatacagcaaagtgcaatttaatgagatgagcctgtaatgagcctctttaaagcaggaactgtcttcctcatctttgtcaccagtgcctggtgcatggtagcctctgaaaaaataattgttcattgaatgaagcacagtagagcaagggagagtgattttgctcgggaggaaaacaaataccactcaagaagatggaaagatacagatgagggttttctaaggcggattattaaactggcaagatggaactctggagagatggagttctttccagaaagtagaagataaagcctcaaagtaattaaaatagggaatatcagttaagttgtagattttattggcaatttgttatcttagcaaaaccaagtgaactgctattctggaattaattttgccctaaaaggaataattaattgataaggagaaataagacccgtaaaaagtgtcactatggattcagaatttatatgacaaagaaaggaaacactgaacacaatttgatgtgctgatggcctcgttcgttcattggtttcctgcttcagtaaacatttaagagcgtgccatgtattttcaaactttagggcaacaggctaaaaatatcaaggagaaaaacgtttactgagggtatagaagtttttatgatcttacttttattgaacattaaaacatggatgttcattctagaaattttagaaggtgaagtgcaaaaacaaaatgaaaatcacctcacatctcagtacccagaaatagccactatttacattttaaaagattgcttccggtcttctttcctatgcatttttatatagttgtttgagataatagaatgtttaaagtgttgtatcctactgtaatcataagtcttctcttattcttagttcctcagagatgttatttttcgctagttgcagtttattggggtaccacttttgtaaaaaaatatttcccaatttttgaaaattgtgacaaagaaaagtcaaattcgtgttgaatttatggaaggaaatctttaagaatctggaggcttattactaacaagcttctgagaagaaagccaagtaaagtgttataataccttctgtccaacaagctacttatgtataagtgatgttacagaataaagtcagtgtggtcaaaaacagacagtcagttatcagaaagttgataagtaacatttatcctatgaaaaatatagctatgaatttaaatcaatagttttctaccacaaatatcttaatggataaaattttctttaccaaatatgtatggtgtcaaggtgacaaggcaagtatccttgtaaactttccgaattacaggaacaactttgcccttcttagcaagcaattttatacagaaactcaactttatgatgggtttctgtaagttttaatttttataataactgatatgtaaatatttagttacctttaacttatctctccaggtagaatggctagcagactgttttatcttctcaaaacatttgtgtgtacagttcccatgttcttttcaaggttcttgcttctaactgtcagttaaggcttttgtagcctcttacttcagttacattttctggccaagacgcaattaaagaatatagagctgataattatttccatagtcgtttccaatttttctactgttccacgtaagactttgaggaacacctttatgcataacacctttctacatttgattcatgtaagtggaatcactgagtcaaatggtgttaatgtttctaagcttcttggaatgcactgcctgaaactttctcaaaaggctgtagccatttacactcataatacttcaaagtgccaatctaaccatgtccttcccagcatggagtattatttttacttttgctattgtaacaaggaaaattaaaccatctcattgttaatatttgtgtattttttatttctagtgaccacaaatgttttcttttaaatatctgctgggtgtttttcttcttttttgagtaatgtgaaaacaaaacgaagttaaccaaacacaactcttccaaacttttctgatataatacacacttttttgtgtgttatgttgaggggctctagttggtaacagcctcctggttacataaatactgtacagtttaattttttttcagctaaataagccttatccctttatccatccttagtggatctattatctacccattaaattaaattttattctctataccaactcctgtttcttcacattttttaaatatatgcagagccctaaattacagtggctgtcctaataaaaggctattcagttattaacagaaaaggaagattgcttcctgcctcttgggtgaggaagactcatgtataccatagatatggtcagtttacatttacagttttctgtgaggcattgatttttttcccccataaatatggagtacttagaatgttcaaaacctttctctgggtaatagaatgcacaaaagtataaggcatgatccctgttcattgcccaagctggcgtgactctggtcatgcagcggacttcatgatgtgatagaattccttgcctatgagagtgaaggagatggtaccaggtctacttgtggccggtggtggaacacttacattattctaagtcctttctgtctgtagaacccaaatgacaaccatattattttatcttctcttattgctagtggtatcgtttattaatgccaacgtatacccattttgcttttcaaggttactttagatgtcttaggttggaatgactgaaggcttatacattcaaatttatatatgacacacacacacacacacacacacacacacacacatatcttattgttgcctgctatctttctacctgttgtataagaaatcctttgaaaaaagcctatgtcagcttcacaaaagatgttactgtgttttgggggaaataaaattgggaagtaataaaacagttaataaatgttacaagaccgtgtacaccaacttaaataagattaaggtcaaacgtatggtaccttatataggtaggaagagcagtattaattagaataattagggagagttgtttggagagtggaaaaaaacattgttctaggaagaaattttgtaatactcaggtaaagtaaaatgtagggccaagatattccagatagtgtagcagcataaacaaaggtatgaaagactggcttgtttgcgagtcagtgaagacattgttctctgagaatctactccagatttttttttttttttttttttttttttttgctttttgagacagggtctcactttgtcgcccaggctggggtgcagtggtgcgaacatggctcactggtgccacaacctcctgggctcaagtgattctcctgcctcagccccccaggcagctgggactacaggcacacaccgccatacctggctaatttttgtatttttggtagagacagggttttgccatgttatccaggctgttctcaactcttgagctcaagccatctgcccatctcggcttcctaaagtgctgggattacaagaatgagccaccgcgcctggccactccagatttttaaaagggaaatctgattcagtgcccctggggtgaactaagtgccttaaattatagagtgagaaatttacattgcatttgattggcaatgggaaaaacattgttaaatcttcagaaaagagaaataatgaagtccgtcttctgtgttttggaataggaatttggtgggtgagtttaaggacagttagagaggggagagattatttcgttttgttttgaggtaattgacatgatgagggtcttaggatagcaatgggggaaggaaaagggaacgtgactccagaggtttttcttaacaaggtagaattgccagaaggtaatcacagattggacaggttttaaagaaaaagggagttatatgtcttcaaaatttgaaggcgtggtgacacagagaatggtgataccattgaggaaaagaggaaattgcaaactgagcggagcaacagggaatagatatgaatttgattgaattacatacttatgggtttatttacaatttctcttcttagaaaaatttatttttggtggctcatataaatgtatgtgctgccataccataagcatatatttctcattaatcctttcaaaaaccctgtaaaagatatttgtatctccattgtgcagatgaggctcagagaaaataggtaattttctcacattgcaaagcagggatttacgtgtacttttaactcctaaaccagcgatttagcccctcagctatactttcttcctgagaggggacagtggcattttgaagaggaaatactctaaagccatttgaaaaggggaaccgaagaaagagtttggtccacagcatgataaaaatattacttgcacttttattatactttataacaagaagtacaggggcagagaaaggttcctaacttttactgagcaagtatatatccaagatacatctcctctttggagcttttgagatacactatctctcttagttttgcaacagccctaggaataggtactattactgttccctttaaaaatgaacaaaaaaaaaatgaagcttaggaaagttaaggttactagaccaagcttattgggagaccatagtgatgaagaggaagggctttagggtcaaatggatttgaattttacttcttaggcctttggtttccttatttataaaatgggattgaaataatgatatcacagttgaaggtaattatatgagaatttatgttatttattgcaaacatagggtaagcacctaataaatgataacctgagaatttatgttatttattgcaaacatagggtaagcacctaataaatgataaccattattactattattttacagcaaagacataaatagagcccattaagttttcttctctacccagtagtttttccattgtacaatagtactctcctgaaggacagcgggtgaagctaagaatttggaagaaatcccagatagagaaatcttgaaaagaagatagatagatttaatactcaatcattaaaaaaagtgcacatgactttaagaaatcaaacattgtaagaggatagtattgaaaagtaagtctccaaccactcttggtatcaatcccctaattttacttcctagagacaattaacagtatagtttttatgtttgcttctgtaaatatttttgcatatacaaacatacacataaaaatatgcccatttttgcacattgagagtataataggcacaatgttctgttctttgatgctattaccttttacataattaacctggagttttttttttcctgtagcgcaatagactgacagatggtgaatgaaaacttgcactatggagagttatgtcagtgttttaataagacaggaacccagaaataaatgtacgaagtttaacatcagcatctcgtggcctttaagtcaaattggacaaccattcaaagcttcataaatgctaactgcttctcatgacttcagaagcaaacaaaaaaatcattattcaaatgggaaattaagctgatcatcagaagtacagagaggatgtcctttcttaaaggcggcacgtctaagggagtgtctgagacctggcttcttcattcaggatggaggctgctgctactctttaaaagaaatgttcacatccttacttcctgacttccttctataacacagtctgcttcacaacactatgactttatatgtcagagcgggttaggaggagctgaatcttaaaaatttaagaagatgccaaggtctagaaaccactcttaacaggggaaaattagaccctgcttgcttttgggaaaatttgttttccagtcagatgtttgtcaaggttaaagaaattcacgggccctctgttcgaattgggagcaattgggagcccttaagctgaatgagtagacttgaagtcccacttagaatgagcctttatatttttgttctgtggcttgctcagggaagggatacacacttggggagaaaaagacttggattctagttgatgtttttctcctagctgactagggaattcagaacaagttactaagagctttctagtccttagttctctcatttggaaaatgaaaattttaaattagagattctatttctaaggcaccatgtatttcattttcttaataaaaagtatatatattcccctaaagaatactcataagaaaaaggtagagttaaaatttcccaaattatttaattcctggttgcccagtaaccattaaatttctcagcagtcaggcaagaaccacattcccaccttgagacaagatttaggcctttccaaacttaccctcgggctctgttccaagtttatttgtaagtcagttgcatacaatttggaatgaaatgtgttataaatggtggttaggtccctaagtcacagaatcttagttaaccctcagagtgcctgatatactgcaccatgtaaatagaaagcagctgtatgtttctatgggagcaaaaaacttttgtaggaaaaatggtagaaactcgtactgcaggtgttgattattcagcaaacttctctagataaggaggactgggaacttcatcattattggtctagttacattcctggtcactccctcatcccattgactggtcagtttccctccctgtggtccttgtgcaagggtttctgcctcaccccataccctctgctccttgcccggtatcatggttcttctgagggtactactgcccattcacccttgtgctaattaggattacactgggtaaggaaagacatttgttctgtagcggagaagcggggaaggccatcagaggctttgagtgtcagaaagatttggtcttgaatgcaggctctgggatgcaaccgtagggaagttaccaaacatttgtgagcctcattttatctttaacaaagctgataatacagaactcagggccttgtaaggactcgatggtatcaggtacacacgacatttgcccttgagtgctcagcgaatgttagtattccttctgccatcggcctgtcacttccgtttttctctttggctctacagggaatacttgcatacaaaaagagctgaagtaagagtcacctacatcttaggaaaaaagggctgctttaggtttatcctcaagtagttttgtccaggattctgaggagaataaaagctgggtcagatccagtgtgttgaaaagaaagctgaggtgagaagtgagagaaacagagaggcagagaaagggggaatgagccctgtctgctatgaagtaggaggcaatccaaaagacaaggaatccgtggtcattgccactgagaggagaaagaaggcaaactcactcctgtgacttcagggccatccatgaggtgggcagaggaactcagagtctgcccgattcttggattgaatcttcaaattggtaaagctttatatcaagcaactcccaaatgcagcatagttttgaggtgataaagaagagtcttttcaaggctgggcacaatagttcacgcctgtaatctcagcactttgggaggccaaggcaggcagatcacttgaggtcgggagttcgagaccagcctggccagcatggtgaaacctcatctctactaaaaatatgaaaattagctgggcgtggtggtgggcacctgtaataccagctacttgggaggctgaggcacaagcatcacttgaacccaggaggcagaggttgcagtgagccgagatcatgccactgcattccagcctgggcgagagaatgagactccgtctaaaaaaaataaaaataaaataaaaagagtattttcccggagtaccggtaatattggttccagattcaaatgtattgtccagatacacagagggtaaacaggaacgcttcaggcatcctttattaaaagcacctcagtctatgtcagagggccaggcagtccattatctaatgaaaatctcctaccattgatttattttatcataactgcagctgctaagtaattttgtttaaggaatgatttacatattagtgtcttcagcaggatctcatcattagcatctagtctccagaaaagttaacacataacagtgaaaagaaaacattctctatcacatgcttctgcatgcatgggcaatttgagtcataccacctgttcccctcttctgttatgctagagtatacaaaaagcagagatacgcatagtttactatgatcctagatgcttaaatatcttgaattgtgttctatcttggactcattattcatgcataaagactcaacagattctcttcttgcacctctcaaacagcaacatcaacaaaacccaaacaatgtatctttcctaatgaggtgaaagcatgcataccagcctaagacagaaatgttgcaaaaatgttttttgcaagaaggtcagtttgcttttcccatggtaactaaggttaatttctactgtggttcattttggcatccattttattcatgatgattattagagggcatggatattgggggtgtgttgatgttgggcaccagagaaatggaaagaggcagatggaggatgcaaatcattttcactcagaacctaaaatgtttactgttagataaagggtagagaagaatcttaatttgactgtcaaaacatatgattagttgaagttaccaaaactatttttttaaataacatttatcttaagagctataaataaagaggaaattttgcactagagatgaagttatgaacatttcattaactctaaagagttaatgaaaaactagttgattatatgtgttcatttataggttgacacgtgaatttccagagaagtaacttgtatgtttttaaattccaatccttatcttacatctgggcagaatcagacttgtgaacgtcccattccaaacaaatggctaaacactttgcagactttgtctagaagagtgccttacccatataagccctctgttataaaattgttttaaacgttaaattagctgtcaagctgttctgcatcagtggcaccacctggtagcaaggatggagatctctgccacccaagatctctttagtgctcacgtcatttctccaccgcaaggaggattgcgggggtggacgatgctccctatttagtcttctgcattttgttgcttacagttcaattaacatgtcagttagagatgacttttggttgcagttaataaaatatctgaccaattgtatcttaaacacagaggagttgatattttttgtagaacaagaagtctggaggcaggtagttgagagctatggaagagttccgtgatgtcatcagagacctgggccatggtttattctgctgtaccatttttaacgagtgactttggtcctgatggttccaagacgactgctgcttctcaggcaggaagaaagagaaaggacgttcagcctcagagtctctttgtctttccatttgggaagggaaatcctttcttgcagatatcttctcaagcattggccaaaactgtgtccacacagcttcccctggctggatcagggaattgagatcctccagcctttgtagcagagaaagaccaaggagaaagaatttgggaaggggtgttgagtgagccaacatacagttatctgccacaattaaatacagcggattcaccttgcaaataagcattctttttagaccatttattttctttctctctttgtcccaattcctttattccttaggaaagtcttgatatctttgtgaggtgtgtttcaaaaaagaagctccagctcaggttgtaaggagtaagcaaaaataataattccagtgattcagccatagaagtggaaaattatattatttgaagaaaaattagatgtaaaatcaatgtcatcgacagcttaaacctggtaaaagcaaggaagttcctttcagaatctaattttattccaaatacatttattgagcaccatcatttattgccctagatgccaaggataagtgaacacaacatgacctcttcagaagtctgcatttttctcatcttttttccctcaagtataagaatgaaaaataaagctatttctaattagttacatcagtcatttctatcagtattactatagattttatttttattgtatactggatatttaaactaaatttaagcctttgtgggcttagaaattactgtttcatgagtaacatggcttatgtaggaaatttccaatgccattaaccttaaaaatgttcattggaatactgcttatgtcatcttggaaactacctttgcggttgacatataaactgcacgatggtctattttcattatatgtttctgtatgtacataagcatcctcatgataaagattgtctacttgatcaaacttcagccagactcctgaaccttctcctaggcccacctgtgcacttctttgtaaaaatccagctgtagcgagaatcctgctaaatcagtttagcaagaaccaccttcctcttatgtatctgatcaggttcctcatcctccaccatcccccatgtgacgtctgatcaccctggcctgtgtcttcagcaaggttcctgttaagttttttttagctagaatcccccttacccccatgctttctcttagtagttttccatccaccaaaccccaccctgctccttggctatcaattcccacttgtccatgctgtattcagagttgagcccagttctatactgaggtctctttcccactattgcaatattcctgaataaaatctgtttttaccactttaccgtccatctctggtttttctttgacactcacataaccagagttttgtatgtgtgtgttgcttgacacatcacaaatacctgggatacgtgtactgattttttacagggtgaataatctttttgttttccccaatatcttagaaacctgaatctttaacccctgggcttagtacacagttaggcatataataggtgcttaagtaagcgtcaactgatgattttaaatgcagaagtaattgtcacttaatgaaatatagtcaggagactcatggattttggcctgtcttcctacctgttcttgtactgcaacagtaagtgtattaaggcaatatttttggcagcacaatcatttagtttgaatgcattagtaaaaggtggagtccaaagaattaatcgctggaaagttttgggaaaacccagtaacaactgtttccatagagtaatttgagtgacagccaggtaatagctacttattggagggactccacagtcagagccttgacagggacctgaaaaagagtgtaactgaagggtaaatgtaaaagcttttgggagaacaagggagtggtcaggctgaggcaaagatctgaaaagaaatgcctcctggggccaagctggtaatttgaatgactgaaggtgactgggtgggaactggggcaacctgaaaagcttctgttagggtaacagagcctccgttgcagctgactgttctatgagaatgtgagtctctattgtcaggtcttcaggttcttccagagaagcaagacaacgggaaatcaccagatttttaactaatggcgtatcattcaacaatttcaaaaaccattatgtgagcccaaactgaccaacgaatcaaacacacacacacacaaaaaaagagtctgcagactaaattcaaccagttggtgacctctggtctgtggttaccagagaagtaattgaaatggagttttgggagaaagatcatatgttgaaatcttgggagataagggcagagaaataagtaagccgagacggcggtaaggccaaggtagaaaaggtagcctttaggaaaattaagttaagactttttaaaacaggaaggggcaaaagatgaggttaaagcagatgaggaaatttactgttatttattttcatcattaaaatacgctttccacaaatttttcaactgtaagagagagtgataaattcaaaataggtaatgtcaaccatattatgaagagtatgtttttgcaatccaaaaaagctaaggcacaacattaaaaaaaaaaatctgtgaatttggctttgcaaaggtataagaattaagtcacatctgatcatttttagagtcttaccttttataacaaagaggaaaatttaattaaactggctctgccctggcgaatctgggatgtgtgttcacttatgaagagagactgttaagattcgttaattaatgaggttgagaatagagttgaaggagattggggtaaatttataagtttgtgtcattctgagagttctgtaagtagctgagttacccatgttgtgactgagaaaaacaggagagagcagtgactgaaggttctgagccaaaggaggagaatagtattgtttattccagcagccagagtggcctgtgtgactgtaagtcgcctgtcaagagggagactgcaaggaaagtgcattgatttgatttggagtagttgtaactgcagcatgaagaatatgatatatagggatgataattgaggaacaatttaatggctgcataccttgctgaagttgaagttccttctggagataaaggtggcaaaaaagaaagtgcttaggtagaagagctttttaaaatgagttaacagaaaacagcagactaaatatggaattgaggagtaggaaatgaaggaaatgaatttgaagatttactttctttcaggatgcagagctggtatgtaatccctctgtttccagtgccttctcccacttccaaatttcactgctcctcatgcgccctggtgtgtggtgcagcttcgagattaagcctccagccttctgtcaggatgaagcagcaggtggctgagatgctaggctccaagtgggggaggtgtttagggctctaaagactttcaaccagtccttgtattttcagccacatttcagtcttcagaggaacctggagcctttcatttctgagacttcttggctacataaactggcatgcgtcttgttagttcctcccactccctgccccaatctccttgtctccccaacatcattaattgagcttgggatttctctggtctcctaagttggttaccagcaggtcattttctaagccaccaaaatactggagctctgatctgttctcatctcctctcctgttttgttaattttcttttgggtaaatgccattttttattcctcttctatcaacctggtagagtttcagggataaagagagacaaatgagtctgctccatctgctgtgtttaactagaagtcccaacacccaaaatccttcacacgatgtgcagggctctgcagtgggcctccccctgcctacctgtcaggccttatctgtgcccactcttcctccttcctctctgagatttcagcaatattggccttctaaggattcttaaagccccaccttcttctctgcttcagagcttttttttttttttttttttttttttaacatgtgctgacctattacgctgctgtgttcttacctggcacgctcccatcatccttcaagtctttgcttcaatgtcaccttctccaagaagcctctcggacctatgtttccctatgtatacagtctcatcacttcctgtgtgtttccttcaccattttaccacagtacatatgaatatttgtttgttagtttgtttgagacggagttttgctcttgttgcccaggctggagtgcaacggcacaatctcggctcactgcagcctccacctcccaggttcaagcgattctcctgcctcagcctcccaggtagtagctgggattacaggtgcctgccgccgcatccagctaattttttgtatttttagtagagacggggtttcgccatgttggcccaggtggtctcgaacttctgacctcaggtgatctgcctgccttggcctcccaaaggctgggattacaggcgcgagccaccgcacctggcctacatatgaatatttgattattatccatctccttcgctacactgcaaagtcaataaaggcagagatttattttggttaccagtgtattccatgtacttggcatggttcttggcttatagtacatgcacaataaatattgaaaggatagatgaaaggattatggatagatgaatgtcttttaagcagttataaaacagttctgcctaaagagtcttttttaatcagtagtattacttcaaatacatatttaaatacacatatgttataaatatataaaatatgtatttaaatatgtcatttgtactattttaaatgtatttaaaataatatatgttatatattaaaataatactaatgatttttaaaagatcaggcaacactgctttgtagctttttagaagacatttatccttatggatccataattattatggattgtatgttttatatataatgaaggttttgggagttagagccctgatccttccgctcttgaagcttgatttaaaggagcatggcacagtggtgcctatatgagtcagccctccattatctggggcagaattcaggccccagaaatggtacttaagatacacagttctcccccagaaaactttatatcggccatttgttacagaaactgctttctcaacaaaccttttaccagggcagctaacaatgagcaaaactaatttgaatttcaactctgccattattacagtgttgctaagaagtagtgagattctgctgaggaaggccaagcaagaggagggagccagaaatgccttaaacaatccacagccaggattttgtgctatcttttatttcacagttgaacttctcagtattttttggttcataacctttttctcttttcctcaattctgagtcttccacatttgtgccatactaggtactttattgcttctctcccttttttttttttcttgagatggagtctcattctgtcgcccaggctgaagtgcagtggtgcgatctcagctcactacaacctccacctcctgggttcaagcaattatcctgcttcagcctcctgagtagctaggattacaggtgtgcaccaccatgcctggctaatttttttgtgtttttaatagagacggggtttcaccatgttggccaggctgctctcgaactcctgacctcgtgatccgcccgcctcgacctccataagtgctgggattacaggtgtgagccaccacacctggccctctccttcatttcttagaagagttttacaaagtcattggtgataaataagtaataccatttcacatctggaaacataacttgatagtaattataaattcacagactgtactttctgtacttatctaagtatgaatgcataattcctgtttatctgtgtgtaggtttatttttcccccatttaagtaaagctctatgttgatgatgaggtttttacgagttgagattttaagaggcctcaaatatatctaaaaaattatagaccaagtatgatgtgttagtgttcctcttctctcagctaattctttaaagatatgttccagaattcctggtctgttcttgaagatctcccaataattctagacttctgaagcctggatattttggcttaatttgctttcaagacagactggatttaaattactcaatttgtctgaagtctcattaagatccaaggttcttgtctgttctagtgagtttgagctggcaagaataatacttgtcatctgaaaagtccattagaatcctttggaggagtgagactggaaaattggagacatattattatattttaaaatatgccacctttctataataggagtatgtggggagactgccttgttttggcttcttgggaaaatttggaaaattagtaaaataggcaggcagtagtagttcaatgcgtattgtatgccaaacactgaatttagaacaatactcccccaaaagcatatgtgctctaaattttatttttcacttaccacctgggagatttggattaaatttcttctgggaaatagagttggtatgaagaaacaaagaccactataccaatttatctgttggaataatcatttagccgtacagctctttccactcataaagttaatgaggtcattattgttctttctagctaatagataggcatattgaaaccttaggcctttccaaaaagtctccataagccattggaaagatagactaaaacactccttgttttaaattctagacctcagttcagtcagagatagtaggatttttgcagtattattaaaaagacagaaaccagctataaaattgaaatgaagggacttaatgttttttttctgtaatatctttggaatgcttccatggctttaaaatgctgaggtgtttctcactatttttcaaaagcatgtaacatgtagatatgtgacgcaaacttgaccagttgttcctcttttctggtgaattttgacacctgctactattacacagagtaaaagtgaaagtcataaaacagaaatacttaccaaagtcaagaaaaatgcatagactaaacaaaggggcaagagaagcctattacttgtttcatgtttcaaaataaaagatgaatggcctatcacttcagtagttggaaattcaacttgagaaggtaggtggtttgatgtttgcccttgttccttacgtttctagatttctctatttataggctagaaccagccctggataaaataatacaagttatgaagagaaatgtgcagttcagcatttttacccttctgaagtgcgctttctcccagctgccatggaaacatggcgtaactggtttcttggatagtctcactcctcttgagttccggctgtgagagctagtgagctcattacaacttggatcagagtcctggaaagtcagctcccagggaaagtggaggacagtctctcatggggcacgggaatggggggctttagctttattaaactgcatacatactttcactacacagtcatcccaagctttagcccaggacagtgtcacattgttcacagctgtattgcatcttgaggtttctgtgtgcatcctacacactttcctaaggcagagacttatctcttccagctgtaagccggagggagtggtgctgcagactcctagcaacacatgcggactcaaacaacacaggcagttaactctcttgagtagtagacttgtagggcaccagaactccgttgcagttcactgacagttaccagatatacatttgtatggcttccgtagcattgtgatggaagctaaacgtttgccctgctactttcttttttttttttttttatttttttattttttttttattatactttaagttttagggtacatgtgcacattgtgcaggttagttacatatgtatacatgtgccatgctggtgcgctgcacccactaactcgtcatctagcattaggtatatcacccagtgctatcccccccactccccccaccccaccacagtccccagagtgtgatattccccttcctgtgtccatgtgatctcattgttcaattcccacctatgagtgagaatatgcggtgtttggttttttgttcttgcgatagtttactgagaatgatgatttccaatttcatccatgtccctacaaaggacatgaactcatccttttttatggctgcatagtattccatggtgtatatgtgccacattttcttaatccagtctatcattgttggacatttgggttggttccaagtctttgctattgtgaataatgccacaatgtgaaggacctcttcaaggagaactacaaaccactgctcaaggaaataaaagaggatacaaacaaatggaagaacattccatgctcatgggtaggaagaatcaatatcgtgaaaatggtcatactgcccaaggtaatttacagattcaatgccatccccatcaagctaccaatgactttcttcacagaattggaaaaaactactttaaagttcatatggaaccaaaaaagagcccgcattgccaagtcagtcctaagccaaaagaacaaagctggaggcattccctgctactttcttctggtatgcctgaatcactgtttgagaatggattggactttggtgcgtggaaaactggtagcagaaggcttattcactgcagtgggttgggggtaggctgaaaagatgtcagggaggattaactagaggcagaatgtgtcatagttagaagtatttagaagggaagaaagtttgaactctgatactgttccacactaatattcatgccctgaaagaatcagatcattcttgcctctcccacttggatctctagctactggaatttgccaattcttgatatgaacgctaagatttggatggagcttgtgacctcatttagaccatttgttctaaatgctgaatagaaccaggaaaataggaaaagagggtagaattggggtcataagagaggaatcgtcgttctttgaaagaagaaagatgataggaaactaggcacatgagttacgaggcagtggagaaggaggattagaaagggaaaaaaagaagagaaactttatgccaatatcttctacaagatgtttggctggcacaaaactaacactcaatacttttgcataagtaaaggaatgagagaaaatttgggattggatgcttatcccctggaaactgctacaggctggtgttaatgggaaagggatctgtatttgaccaaaagtgcatttccacgtctctacatttctttttataaagagtcaaagggactcaatgatgagtgtgtgtgtaagggaactccacactagcaagtacaggaaaaatttgatggtactggtgaaggatgttgcaccaatctggaggggaggacaggaattggtttctcatggattgatgccgcaagacaattcataccatgagttggctgagaccacttaaaaaagtaagcagtgatgactgggcaaaagagacaaaggaagaaccacatcttttaggggagagagagagaaggacaattaaagggactcaactagatcaagttctgctcactaaaggacagcgtccaggcaaatgttaattatcttcaagaagcaatctgtatatatagcatttcaagatactccgagatgcttttaatttattgaatactttttattggtatttatcataaacaagagactcacaaatatatcccagaggggaggttttggtgtagttgactatagtagttattaaataatctattaataaaagcccacaaaatggaagatagaaagatagaaaaacaaaagacaacacaggatggtgttggtatacagaatttatacttgaagtttaacaacacggaacaagaaactttattaaaatattcatttaaagaacttccatatgaatcaccagaggctcttagtaaaatattgattcggattcacagatctgggtggggcctgagattctgcatttctcataagctccaagcagatactgatgctattcttcctcaaatcacactttgactaacaaggactcacacaggttctctgtaattggtgttggtagtcattcatggttagatgtagttgaggactgccctcttaactacctctcggctgccaggttataaagaaagcaagtctcagtacaagttctgtcacttaggagcatttattagccaatgggtacaaaacaatcttacagcctgtgccagagacacagtgaagtcacagttctgtcttttggggtgcttggtgtgagaggctcacagtctacacaggccacagtcctctattagagtggttctcaaagtgtggtccctggaccagcagcatcagcatcacctggaaacttgctagaaattcagattcccaggcccttcccatacctactgaattagaaaatctggaggtggggcctaggaaatctgcatctttaaactatccactccaggtgattctgatgtttgctcaagtctgaaaaccattgttctagcagcaggattccctcaaccatctaactgaattctggcaactaagaatccggtgaaccacagctggacattttggaattcagcctagggcaccatttctaaagatggagaacctactggattcttcttaaactcaatttaaaggcagggagtgtttctaaatgtttttcaacaatcttcatattttgcaaaccactaatatcactacacaggcccgtctaactattaattaggaaaattaatgaaacccctggtgtaataagagctaaatataactgaatcacttacagtggccgcctgtggcatgaggctttttgattaattgctagccaaccacccttggagttcactcctgattaagacaactgaccacctctacagtgtagcttaagctaacacacacatacatcagagtgtactgttcatgtgagggtttttaaagactcttaaaatttaccttatcagggcataatttaaacactataacatgtttccattttaagtgttcaggttagattttggcaaatgtatacactcgtgtaaccaccatgccaatcaagatataacatttcgatcacctagaaaacacccttgtgttcctttgaggtcagttacctactcccaccacaccccaggctaccatctggcatagtagctaagttttgcctgttctagaagttgatataagtgaaatcaaacagtatgtactgttttgtgcctggcttcttttacccagcttagtgtttttcagatcagttcacattgttgcattatcagtagttagttcctttttattgcactttgcacagtagtatcccactgaatgactttaccacaacttgtttatccattaccttactggttggtttccggtttttgactattatgaataaagctgctatggatattcatgtacacatctttttgtggacatacatttttttttattctgtgcaaatatccaggaaaagaatatttgagtcataatatacatgtgtgtttaatttcataagaaactgcctaactggtttcccaaagttgtcgtacattcccaacaagcagtgtctgagaattccagtcgctccatatcctcaccaacatttggtattccggtcttttaaacaaaattgtatgctgaatagtttaaattacagacattgttttctttcccctagttgaaattcaggcttttatgtttggtctctgcgatggccataaagctgaaaatgttgacccaagtgacttggatatggattgaattattgccctttcctaacacctcatcagaattggtttcgtaggtgtcatttgattatggcagtcatgtatgtcagtgtactttttctttctttcattcttttgtttattgattcagttggtcagtcggtccatgatctgtattaaaacagctttttcagagggcagttgcatattaagttgctaggaaaaatgacagaagtaggtgacagagttcttgtcttcaaggagctttttggagctgagttcctgaaataaatgtagcccagtatctatcaaggcttgtgcagacttgagtaagaacatcatctaaatatagcttcctgctaggtggcgtgagtcagggcttgatagaccggtgactgcagaaaccacagtaacatatattgttgttattctgtgctgaacattagaatgattgtaccttagaatatagagccaaatgtttattttattcctaattatatttttaaatacatatcacacacatagacacatatgttggataaaaaatactcaaaatgttaacagtgcttatttaaaaggtttatataaactttttttgtagagatgggatctcactatgttgcccaagctggtcttaagctcctggcctcaagcagtcctcccaccttggcctctcaaagcgttgggattacaggcatgagccactgaatccagccagttgtgcctatttttgagtttatgggcttgtggatgatttatttgattatatatgtatatgttaaatgtctaagttacccaaagtgagcatgtataacttctacagtcagaaaaaatgttatattgccacttgattgtttaaggtcttatagctatttaaataatgtatttcttgttctctttaatcttgtgcagaaaagattcactacagtagatccagattactttctagaaaaaaataatgcctgtccatctctttcctcttgggaacaggactacatgaatgcccttcaggctataccactttagtcttcacagaacttagccttcctggttgtcaaagggcaaaaggaattattttttcttttccccacgttaacagaattttcacctccgaaagcttggcgtatacacactatatgttttctaggctatttttgtggtggttgtagttattggcaaatcactgggcgtcgggggtgggttgtctgttatttctgatggaataacaaatgctctttgttttccctcttttcagctgacctgaataatgtcagattctcagcttataggactgccatgaaactccgaagactgcagaaggccctttgctgtaagtattggccagtatttgaagatcttgatactatgtctttgcttagaataaaaagtaggttgggtacatttttacttagagaggggagaaacagctgtcacaattcctgttgcaatgtataattcattctttaatgtatccttggcctagagtttgcctagaatgttttgttttatttttagaatcattcctgtcaccattcctcagctactgatgttgaattaagatattgagaatttttattttccaactactggcattggcatcggcatccataattacctttgtgaaacttgcacaatccttgttctacctttgtttttttttctttttacaaaatgtacttagtattagaagactatgactatctgatctaaaccaaacttcatagacatgtgtggtttattagcttgaatgctaacgtgcagatgaatgaagtggtagaggaaaaatgacagaattgctttcctccttttttatcatacatctgtggaaaaatcctgaagtgttacacagctctatcatgtcatcaaatagtttatgtataactctactattgtctgagggtctgtgtgcattgatgatatgcccatgaaacaggcacagtttctttttctttttttctgtttttttttttttttttttttttttgagatggagtcttgctctgttgcccaggctggagtgcagtggagtggcgcaatatgggctcactgcaacctccacctcccaggttcaagtgattctcctgcgtcagcctcccaggtagctgggattacaggcatgccccaccatgcccggctaatttttgttttttgtttgtttgtttgtttgttttgtttttttttgagacagagtctcgctctgtcaccctggctggagtgcagtggcgcgttctaggctcactgcagactccacctcccgggttcacgccattctcctggctcagcctccggagtagctgggactacaggcacccaccaccacgcctggctaattttgtttttgtaattttagtagaggcggggtttcaccgtgttagccaggatggtctcgatctcctgaccttgtgatccgccctcctcggcctcccaaagtgctgggattacaggcatgagccaccacgcccggcctaatttttgtattttttaatagagacggggtttcaccatgttggtcaggctggtctcgaactcctgacctcaggtgattcacccgcctcagcctcccaaagtgctgggattacaggcgtgagccaatgcgcccggcccaacaggcacagtttctgctctgatggaacttacagtctaacaagggataaccaggatgttcatgaaatttgtagacataagcaaatatatgtataatgtattaagaatgtctacagttggttaaaaaaataaagtgatcttgtctctatttccaagaccatttcaatgtcatatatttagttgtgcaacagtgggacaatggggtactatgtgaacagctaactgtgtggaatgagattcaaagaatgtttgtttgaagaggtgatgtctaagctaggtaactctagaagagtaagcagctctctctctaggaagagcgttctagtcagaaagaagagcatgtgctgaagggcccagagaaagcatgacacattcaggaactgaaaatatgtcagtatggctaaagcacagaattccaggggaaagatctattgtgaaataataggctggagagagaagcaggaagcagattgtgcaaggtttttaaaacccaagttaaggaatttagaggtcaggggatttggcctgggggtgacataatcagattgtcgcttagaaagatgattcttgctgtggaacagagtatggattggtgcgatgtgggagtgacaggagaaaaacctgttgcagtaatctaaaccagcaatgtggtggcttgaattagcagagtagtaagggagataagtggagagaatttagaaatatttaggaagtggatttgacaggcctcagtgattcatttgatgtggtgcagggatgtccaatcttttggcttctccgggccacagtggaagaagaattgtcttggaccccacataaaatacactaacgctaacggtagctgatgagctaaaaaaaaaaaaaaaaaaaaaaaaatcgcaaaaaaaaaaaaaaatgttttaggaaagtttacgaattcatttgggcctcattcaaagccatcctgggccacaggttggacaagcttgatgtggtgggtgaaagggagtcaaggaagacacttaggtgcttggcttggaatatcaggtgaatgtgggacttgtctggtaaggttagacacggagctgtggtgctcaggagaaatatacaaacaacgtttagggatcatgagcctgtaggtgctgcttgtaacgggggagaggattggatagctccaggaaagtgtagcgtgagaagggaagttatttaggacacaggataagcaacctacagaagggactgcaaaggaatggccaggaggaaagaaggaaaattccaagaggttatgatgccacatgctccatgggaagaaagaaagaacccgttaccagggtcagatgttgctgggatgtcagcataaagttgcggaaaatgcccattggacttagcaacaggaaggtccctagtaactttggtgagattttagaggcacagtggaagtggtgtggtgagttcaaaagtgaaccaaaagtggagaattagagaaggtatgaatgattcttggagaaatttacttatgaaggggagaagagtggggtggtagctagttggagggggctgaggagttaatggaaatgtatgtacagtcacgtgttgcttaacaatggggatatgttctaagaaatgtgttgttaggcaactttgttgttatgtcaatataggagagtactacacaaacttagatggtatagcctagtacacacctaggctgtatgggatagcctattgctcctaggctatacacctgtacagcacgtgactgttctgaatactgtaggcagttggaacacaatagtaagtattgtgtatcgaaacgtatttaaacatagaaagatacagtaaaaatatataatagtgtaatctcatgggctcgctgtcatataggcagtccattgttgactgaaatgtcattatgtggcacaatatgtgtatataagtgtgtgtgtgtgtgtgtgtgtgtatacattgatccttgaacaacatgggtttgaactgcttgggtcaacttacgtggatttttttcaatcaaatgcaggccaaacatatagtattcgtgggaatgtatttatatgagtatgagaagacagggtgagattacaattattggcccaagaggagatgataaataatgggtgttctcagagaatacgggcaggtaatccagagcccaagggagggaagagatacctctcttccactgtaatgggtggggtagagggaaggatctgggcaggtccaggtaactaagaaaccaggtagcagcaaggtgaaggatgtcttactataaaggcttccattttttgtatggagtggagagtccctgcaacgcagttaacagcaggagatgatgaagttgggcttatctttgtggagaataagagagagggcggagttgaaaaccagctgtgtgaacccagaggcggctgagtgtttcacggtagctccaatctgcaggggtgtggtatttccccaggcacgcttagcacttgggagccagatgcttctgtcctggggtagggagggaacagctgggcaagagaagtgaggatttgggcaaaagattgattaaaatgatactgacaagtccctgttgggtaggagaagctgtgaacgcatatggaaactggtaattaggaggtagagggatgaaaatgctaactcttcagggaggtaggggaagaagtagtaaaggaactgaaggtcaagaagttgtggtcagagagaatcatagatgaacattattttgaaggtggaacagtttcaggtgattagatctaggatatagccatttgagtaggtggcagaggtagagtggatgtgaatttccatggaggtgaaatagcaagttaaggaactgagaggctagaatgatgcatgagtcccccatgccaatgttgaaatcatgcagaattggagcgagaactgggcaaaagagaaggaccgtgaaccctggctgccaggtcttcagaaataaaggggttcaaccagaggatctgcagaggctagcaataagatagtcaaggagtcacttggcatatggttcttacacagagatagagaagaaatgccttagaagtggaattatttggaaagagagactaggccttttcccttcatcttggtatccccaatgcttagtacaaaacctggcacacagcatggttcaatatgttttcatgagatgaatgcatgaatgaaagtaaaccaaggcttccatttccttatagcccgaagttatcatttttcagctatatagttgccaagtttaactggtgtttaaagggctttccaggtcgagggtttccttaggacctgttaatacgtcatagctgggaaaaagtagtttgggatgggatcgagtcagggggctgaatagagaaagttttcttgcctctttttcttcacctgcccctgcccctgcccctgccccatcccagagctactgctttcctttaataaaggagtaattaggcactggttatcatgaagtgctagagaatattcctgtgagatcctaaaagttcagaagctaaccatttgttccagtttatactatggaaaaaaaaaaaaaagaaacccagaaatagaccagatggaaaaaccttataatgactgttcctttctataatgtccattttcaccctggatttaggcattattcgattttcctgctcaaaaaaaattccattcacatatgtgttttattgtctgtcatttcaacttataatttccaataaactttgggaaaatgggggaatttcataatatacaaaattttgtccatttgaggtgataaccttgtaataaaggtaagctccgaatgtagaataatttctttaaattttcacttttaaatcaatttgaaattctctgcatttcctttctgagcatggcttttctaatatgtgaaaaagattcaagtatgccaaaattaaggtgtatgtatctaaattaagtattgaattctcattaatgctaggagggtgccatatatagtaaaactatagaatgaagagttcaccccatccttttattgaacatatgtgtggtcacattacttactttcaatatatgatttaagaattttctcctaattttatatttgcttagatttagcttccaggcttttgtcatttctaagcctgcaaagccatgataaagagctattgtctgcggtacaggcaaataaaacttgccctggctagctttccctaccaaaggccacttctaccaactctaactttaaggaaaattaatgatgttatctcagtgatttcctggtgccagtgaagagtttgaattacagatgccttggaaatatgcacttccacctctattaagcacttgatcttatttttttttcacttccctatcaatgtttccgtattgcagaaagccaaataacccaattgtatccactatagagaattcactatttaagtggagagcatcaccgttggcctataatgtccccagtttgtaatcagttaagtgttgcatgactccttactgcctctcaacacattggaaatgaaaatgaaacttggtagaaaagcaggaacaaagataaaatcttggtaagaaggatttataaactgtttcatatagctgatactccattgaaagttatgaagaaggtaatttaagcattttctttctccctttgtagttctgatgacattctacaggtgtgaggcttctaaaattaaaaagccaacttgtaagagcagaaataaaaacgcacttaacaaagcaagtgtatttagtttattaataatgtgtggtgggttggagagagcccaaaccatagggctaaatatactgcagttgataagtgtgacaaatattctgcaaacagtaagaaatagagaacattttgcctctattcagcaactaaagcacacattatagagatttggtacaggctggagttgtgtgaatagtcacagtttctggactcgccctcaccatgacaaaccaggtgaaaaatgcaccgccttctctgtaaatgcacctcaccttttgatggtgcgctaagggtgacattagataggcttcagttgctaaagaagactctcaggacccacaataacatggcttacaaatccgcgctctattgccagaaaaggctacattacaagagcattactgtcaggatatggatccacagccacaggctgcctccacagcaagggggtctcgagaggccagtgtaattattttgccactgtcctacaaaaatctactttttctatataccatgtattatttttcacataggttagaggccatgtctctgttagttctgagtttaagacgtcttgaggacatggccaaactaattttctcagtttatatggtttgacagatattagtgcccaagagaggtctcataacatgacccatctatctcccaggggaaatactgtaatcttgtttagctgttacccactagggaaagaatggttttctctcagtcagatgctaaagagattaaagaacacctcgtaggttccgttttctagtaattattggttccattctccagctatcaaccttggcagcttgccatccctatccttcctcctggaattggatgcccttgaagtgcgcttcttgcactaggaagtctttctcgtcagtttatcatttctcattcaaagcaaattctacctggccaggtatctctagcccagttcctaattctcctaatagaagtttcttttatttcaagtggattcatgccccttggcccaccagacatgttgccattgagaaatagcagctttaatgggaaatacacatgagacacaaaaatgtgactaggctaaaatcatatgaatagtagtcactcctaaaaggactttggtttgggtatgtcacagaaatttctgtagccatccatatccaatttctagcttttcagtctcaggaaagtaggcccaccaaattcaacttaaatatctgtcactgattcaagctgtcccaattgtccctccacccactaatggctttccacacggagtaatggggcaaatagctatttttttaaacacataatgttatgacagatgaaacatacagcacgtaagccttctatcacatgcccaatacctttgttaaaccttcatcatcacaattgatggccacacagtgtttattgagattgttataaatcattgttcttcagatttgactgggtaaatattccctcaggttatttcctgacacagctgattaataacagatatgtcctgtgaaagaagaaccaaaagacattaacgaatactaaccaaaagccacattaatattgctccatggtgttgtagtcgcagttagaacgcccatctcgtcatccagtgtgttggataggttggctgactctcccactcacatcttggctctttcaaggaggaggaggttttagcagagtcccccaccccaagaggcatctgagtctaagccaagggagcatattattctcttattttaaacctctccgtaggcagcaacattatattaggttttccctttaaaaaaaaaaaaaagtatcggctgggctcggtggctcacgcctgtaatcccagcacttcgggaggccgaggcaggcagatcacgaggtcaggagttcgaggccatcctggctaacacggtgaaaccccatctctactaaaaatacaaaaaattagccaggcgtgatggcgagcgactgtagtcccagctactcgggagtctgaggcaggagaatggcgtgaacctgggaggcggagcttgcagcgagccgagatcgcgccactgtcctccagcctgggtgacagagcaagactcggtctcaaaaaaaaaaaaaaaaaaaaaagaaaaaagaaataaaaaagtatctttggtggtttccttccccttgcaacaatctcacctttttccttttatcattaattttaagccaaacctcttccccagctacacacacacaccacacaatgcagacagtccccaacttgtgaagtttcaacttaacaattttttgatttcacagtgatgcaaagtgatatgcattcaatagaaactctacttctagatttgaattttgatcttttccaaggctagtaatatgcggtatgatactctctccccttgctgggcagcagcactgaacctcagctcccagtcagccacaagatcatgaggctaaacaactgacactttactgtgtaaggtgttgctagacagttttgcccaactgtaggccgatgtaagtgttgggagcacattgaaggtaggctaggctaagctgtgagtttcagttagttaggtgtattaaatgcatttgtgacttaagatattttcaacctatgatggggttgtgtgatagcttcaattaggcaaggcacaaggaaggagtaatccattccattgatccttgtggaatgcttgtgcttaagtaccaactaatagccatagtatcttattttggaatattaccagcctttgaaactcttaattgtagccccagttcagggactactaggtctggcatcaaaaaagaaacctgtagtgacatagggaatacctgtaagtgccccacttgaattatctttttaattgtaactggtctcacaggtgtagcccatttctcaaaaatgatagttgcttcagctttttggttgggactccacctgcaggccagagagggtgaagcccagtggaaagaaattctgaacttaacattagcttttggatttttttttagcagccttgccatcagtttgcaattgcctcctaatccattttgttagctccttaggttcaagttctctcacttccagattccactagaaagttacaccatcagtaaccaatttcaaagcctgtgttacttttcaaccaagcgtagcttgttgagcaacttcaaaggttctttttcatcccttttatcagaatcttctttttttctttctaaataatgcctcagtcatacttttagctaagaatgagttggaggtgttctaaacaatcttgcttctgacactcactgccctgacagtggaagttaaacagggttcaattgctaaagaggactcacaggaaccaaatgacagtgcttacgaatctagagttccttgcagaaaaaggatgcaatatacccacaacattaaaacaagaataagtgtcacagccacagcctgcctcacagcatagggtccagagaggacaggtgcaagctataattgccctctgtctgcaagagccacaccacgatgcattttctctcttggaacaagagctactgatgtgagcacagaacaccttggaaaccagggagcacaaattggagtttcagccagggtttcttatatcccgtgggtaacctaggcatactgttcctatgtaaccagcctcaaactcagtggcttccgttggtctgactgtgcccgggtaaaaatggtcaatgttactgttagcaataaacaatggtgataacctgcaacccatggctacacttcaacacagtaagtcactttgaaaagcaagtgctttgaccagggctctgcactgtgtagatattttagcaagtcatctcgtgccaactccagcctctctggaattaacccttactgcacagacaactacatcaaagtgcattgactttcttgaagtgcaaagatttgcttgggaggtccctcagccataagtgtaagttgcctgtagagtggcatgcctgggcaagaaaaatcagcaaacatacagcagttcttccaccattactcacctctttctgtttctgtgctaattagatcacagaattatttatacatcaacatagaatatacagattgacctataggatgaacttggggttatatgggcaccatgagactttttttttctccactaaccaactttttggtgcttctgttttatcctactgttgtcattagcatggaatgcagaatggttttcctgttctgtaaagtcagtaaggacaccttctgccacccacttttcccccttacaatatgtacctccatgagaaatcagaaaacctagatatcctgccataacacccagagtgagtctccatatctctggtctcagttgtctcaactgcaaaatgattttaaagcaaccttctggctctaagagtctatcactctgtaaaagacaaaaaaaatctgtcttacataggaaggaatagcaagagttagctactgtggcatacatagaaaggaaaagaatgagcttttgaagctagaaggttgagaagatgattaggcacaaccagagcctcaggaaccattagtgggatccctgtgttgaagtcctgcctgctcgccgccccccaaccgccactgtctgcttttcctgcacagcaaagaggatcctggagagtcagccatttcttttatcctgtccccaccctctctcacccccacagccctcatgcatagggtaccaccacatggtccctgttcttcaatggcttcaaagcctatagcatcctctactgtaaacataatttagaaagtgaagatgtattagaatacttgggtttttatgtagctttaaagatatatctactagtgaatacacacaaacacacacacacacacacacacatacacacacacatatatatatatatatatataatatatttaatggaaattcctagcttaaggaaacaatggtttcacacaactgtatctgctggttgcttattgagggtcctagaaagagctaatcattacatttaatgtttcatcaaaaagtctaggtgtgttctctaagatgctcattttgaaaagcatatgcatggcaattaaattgtccctattgatattctcacctccttttcgggtccatagcatggattgtgtatacctaaatggaaattttttcaaaatagctccatgaaagttgaattctgtttgacatgtttgtttagggaaatgtgctcttcagtcttctgtgatggattgttcttgtgtttaaccacatccagttttagcagagcacactgcacagtatttctctcctaactgtgtcatcttctgctcctgtaatttcagagcaattgctttgctcccctctggagctatttctactcaacatttgctgttctatgtgttacccattcacctgtacagagataagagcaggccccataaaatgaaatgcatgcagtttttctctgttcatttccatcacacggctaaataagactcttaatacaaaagtgattcgaaaaattttcactagttacttcttaaatgcctggatcagaggcaaaatatttatgatgactaaagcagagtaacaaaaaagaaaataattgaaaaacttcaaaccacccatagcttccttcagtatataaggaaacatgttgggaatattggtgtttggaagaaatccattcctctcttccagtaatggagctggcataccgtgtttctaagtgttcctactacgtgcacttgagtatgtgccctctgaggaaaacaagcacacagaagagagagagaagaaaagtttgagtcttttgtctctggacctcgctccagcctcccacgcagtcttctttcagccattccctcctcacgtcctcccgtcctcctgcctccttgcattgctttttaaaattctttattatttttctcacttgattcttcagataagtctcccaagttatcttccttcctcccactttaaagaaagtctcagcttccatgaaaagggtcatttctctatctttagagtatttcagagcaaaaacagaggggccttcccttccaagggaggagtgcagactcctgcttccaccaccatgtctgtttcatgcttctggggaaactccaggattttctgttttcctttttttaaaagagaaaaatgtgtgcgcaatataggtggaaaagtatttttgcacaaacctacataggtattaaccactatttttgtttttttcttaatatttaattagaactggccatgaataacttgtaaaatatactaaagccttaagtttgcatttctttattactgggaaaggtgtttactgagcgggatttacctctatttatgtgaactacatttataattgaattgccccttccccctagatgcatgagagatttacttaattagcattgattccttgcctcaaaggactgagaattccaaccagagcttaggtgtataaggtagtataaaagcaatgttgttgtgtttctagtttggctaataaattggctttagagaaatgcatcttttcatgacacttgggaataaagcttgtgatttgctgatgttggacaaggttgaagtttcacttttgttaaatttttgtccccagcataagattaaacacctcctcagatcaagggaattttcctccctcagccttataaagttgttagaggacttagaaagaatattatgaaatacaatttgaaggtgaaaggagaaataagcgagcctcaggtctgaaaactggatagattatgcaattactttagtttgcctatagaaaattttagtggagagtatttttttcacctaatattagggtagcagagagatgctgaggtgactgatatttcaaggagaaaagcgcttaatgattataaatgcatagctagaaatagagtttacacaaccttagccatacagattaatctaacagatcttctctaatgctaatacaagaaagtatcatcggatctctttaaaaatttctgctaaaacattttttttttcttattcaggtgacaattgactctgtttatgtagaacaggctaggtccccttaactctcagatattccccagtaatccaaggatgggaattatatctttgcccatatcttcacccaatgccagtgagatttaagaacaacttcagatcctgaatactgatcaaactcatcaacttagagtcgaggcataaaaataaaacacctttcaaagagagtgtggttcacgtttggtgtttattaaagggtatgagagagtcctagctaggattctcagaggaaaaaggacactgaaaggaaggttttactctttgagtcatttgtgattttatttgttttttgcagtggatctcttgagcctgtcagctgcatgtgatgccttggaccagcacaacctcaagcaaaatgaccagcccatggatatcctgcagattattaattgtttgaccactatttatgaccgcctggagcaagagcacaacaatttggtcaacgtccctctctgcgtggatatgtgtctgaactggctgctgaatgtttatgatacgtacgtatggcatgtttttatttcccgggctctgtcacaggaggcttagcgtacagaatggtgaagtgtaattagcattacaacagggccctggaagctgtggacctaatgctcttcctgtgataaatcatttttgcatttatgacttgaaaaatattttgataagctaggagttaagagccagaatgtagattgctctcagattagaaaacaaacaaaaccctgagacactcattttgcaaatagtggaatgagtcgacatatagcctttggttctttccctttctcgcccatggattttggaattcttccatgcacttcaggggtggcttcctctcactggcggccatggctgtgctcctggagatactggcacacctgtctccagatcagaatggtcttagctgatacttaggacacttttgcagaagattatgaattgataggccaaacaaaatgaaaacaagcccttaatacagcaaacttagcttctcaaactgagaacatttttcgttttcttttgttttttaataagattttatgaagtttcagtttggcgcctccattcatcactctctcttagagaacaattgtttgttttggattgcacacaagggagatatccccagttctgatttttttttttcttgagcttaatgaagacaattgaagaagggagcagaaggaattggtcttaattttgcctaaattcttcttagatctcaaaattattacatgcctcatttcaccaatcaagaacatactcccatttggaaatctgggaaggttttctgaaaagagttgcaaaacaactgttttgccttttacctttgttgtagacttctactaccttttgaactaaaatttatacctttttttctttcttattttgataaggtattgctttttaaaatttcaggaccacctgactattacattcatcatagtcatctaccaagtccttgaacatgtcggatttcaattgtgaactacgttcacattagttttgataagagtttgtattcaggtttcccctcaaatatattttggcactgttttctttgcagatgacatgtgaatgcattctgaatgtataacttccttctacctgactgaaaagtatttggtgacaattttaactccttgaagacctgagttgctgtataaagtggatttgttaaattttgatctaccttttcttaagagggagaaagataagaaaattttccagtgataggaatttgtttagtccattagtgcccaggatttctttttgactgagggatttaataaattttagtagctggaagttgagcatattgttcaccgaaaataaccgccattgggacctatcctttgtgattttgaagtgctaataggcgaattattctgaaatattttctcctttttctttttaccaatatctaagggccagtagctttccgtaataaaataagaagccaaaaaactattgaaagacactttttaactttaattttaggtttcggggtattatgtgaaggtctgttacataggtaaactcacgtcacgggggtttgttgtacagattatttcatcactcaggtattaacccatttatgcctagtgttccattattggaacactaagcttgtgggaattattcctatcctactgctcaaggtcatcgccaaggtctgattttcacaaaaagtaatatgcagcctccagcataaatgggttaagcgcagtacccaacagttgtcttttctgctcctctccctccttccaccctccaccctcaagaccccagtatctgttgttcccttgtgttcgtgagctctcatcatttagcttccacttagaagtgagaacatgcagtatttacttttctgtttctgcattagtttgctaaggataatagtctccagctaatccgtgttcaaaagacatgatctcattcttttttatagctgcatggtattccatagtgtatatgtaccatatttctcattgatgggcattcatattgattccatgtcttgaaagacattttctacaaaatggaaaacttttcattcttatttttcctttttttcccccatggataaaattagcttattaataaatttgttatgtgaaatgctttatttcagttttctatatgcaaatatagaaaatgctatgcaaataaaagcaatctatattaaaacactgatatagcaacaggttatttataaatttattttttagatcatatatttgaatgttgtttaatagagtatgatatttttcttacggagataaacatttatattctatattatgtgttatgtggcctgaagtaattaattttctttcaataaggggcaatctgatgaagatctgagcatttaagagggctgagcagttagttgctggtaatttttttggcttccatgaccaaagtaggtaatttgctttagtaaccaaagtagattggtgaagattagtaattcttctgcttaccaacttaaaccaaggtggctttccataggtgaatagaatttttttttcttaatttatgtagaacttttgcagttcaaataagggtttttaggaattgaaacttggtaaacattcagtggtcaagttggttgaatttccattgcattgtaggtcatcagtcaaagagataatgaatttggaaaagttcaaaacaatcttaataaaacagtggtcaatagagttcacacatcattgagcactttactcctttatttttccttttcaaggctttattcttaactagaagtgtttaccctctaggaaagggtcagtaattgttttctgctttgattcttcataataggggacgaacagggaggatccgtgtcctgtcttttaaaactggcatcatttccctgtgtaaagcacatttggaagacaagtacagatgtaagtcgtgtatattaatgctgtattcttttattaatgttggctaattaccctagttctagatgggaaatgacagactgttcttatttgacagcagattcctcatgtaagatgtagaactgcttttagagtgtcataaaatttggtttgtgccattccttgtcaaacattaaattgcaggcatttaagtagagaatgaggattagcttttccagtccaggtattattttacattacattgactgtgtctgaataaaacacatgttcctaggggataaagtctgattttctaacctctttctgtaagtcggaaaaataagtgtgaagatttaatctctgcacttgtctagtctttgggttcttatttaaagaataccatgtgacattcatgttcaagaaacattgtttattttataatcatcttactgcaagttgtactgacacatccaattccgtgacgtgactaacattttattatttgagagacagatagcttgctgtttcttaaaggatagatacgtaccaccctacagaatttccttttgattacgcattgggttcttctgcttaaaaactgtaaaaccaaattaaaagccaatgctagaggagtgatggttcagatgaccaagtgaccatccattcatattgtgaaaggctgcagttggttttccccttgaaatgcttataagcaatcttttcagtaggaatattaaacaaattcagcctagcttgtcttttctctcttcccctgaggcctagccacacatgtgaggagatgtgctaagcttcaggacaggcaggagataaaagccactctgtctcctactgatcatttctccttcaggagtaagccacaaaatacacaaaccattttggccctcacttttatgtagtttccacttgagttttctcatcctcagaacgagagaaaaataactgaacagcttttgttaaccattttaaaatgtatttcggatgagatgggatacctgtgtgcttttctcctttaaatattgtagttacttagtataggttaggttctaatctaccgtatatatggtatagtgacagcacattgtaaatataatattaaattgaataattgaggaagctttgagttggtgtttcgaataactactaagagggaacatgtttttaggttggtgaaacaaaaatattaaatgcaaaatgagatgtttgaaagtaactcataactttgaaaataaacacctaggtatgtatatcggagagcagataaaaagctgtgcgtacaatctcaatttttagtgccatcttaggtatcctgttaaaacatttaatttcctagagtttaaagtgtgcttatgggtacagaaagctttcttggatttactttttttgaggggcaacttctaggtgaatataaggtatgattaaaattttatatctgagaacaaaacataacattgcaagcattcagtatgttcattcattctgttacatatattgggcacctactatccaccgggtactgccattctactgtagatacttctggcacacaactgaccaagatatggttccttccctcaaggggatataagtctcctgccaaaaacgatagacacatattgaatcaatgccagcataacatgatgtgagctattaattagaaatacgcagccaggcgcagtagctcacacctgtaatcccagcacttagggaggccgaggtaggaggatcacttgaggtcaggagttcaagaccagcctggccatcatggtgaaacacgtctccagtaaaaatacaaaaattagctgggtgtgatggcatgtgcctgtaatcgcagctactcaggcggctgaggcaggagaatggcttgaacccgggaggcagaggttgcggtgagcagagatcgcaccactgcactgcagcctgggcgacagagcaagactccgtctcaaaaaacaacaacaacaacaacaaactatgcacagtatcctgtgggaacacatacatgatggactagaagctcagtgatcttatgactccataaagaagtcccaactgtggtacatttttgaatctctggtgtccaaggagggtggtgctttgggccagttatatgtctcttaatgctaaaacacttattttttgatgtagttacatcctatatacaataattcccaaggattatgttctggcttagaagaaatttaagtgtcgagggtacgtgtaagcttgcgcttcttgcagtgacacagtttatgtaaaagttatcacacttcatatatatacagtgatcattaacttgattcataaaaataataaatatccagattagcacaaattagaagtaaccccactctgtggaaatactggctactcttgagaattgctactggaattgagttggatgtcaggttctgctggcatccatgggtgctgtgttttgactgttgcaattttcttcttcctttgtagaccttttcaagcaagtggcaagttcaacaggattttgtgaccagcgcaggctgggcctccttctgcatgattctatccaaattccaagacagttgggtgaagttgcatcctttgggggcagtaacattgagccaagtgtccggagctgcttccaatttgtaagttattcaccttctaggtaacatatttattctttcatattttagaaattaattaaaaaacccacagagcttcgttttctcatattagctcttcagtaggcagtaggtatgggatttgggatatttggaacctctgtaagtaagcagcttctggaactctaggttttgggaaagaagacagtgctgaggaaggaaaagaaatctccatctgcagcagggaccccacagttattgaggtgctagaggggaagaagttcagcaagggaggaaataagtctctagccacagaaatcctatgtatataagaaaatggcctttgtaggcgagtctcttagtctctgagtcctttctctaattctatcattatagcctcctttcaatggctgttggtaaattgttagcacagctgtccttttttttaaaactgtcctttgtagctttgacattcccctattattccaaagtctagaggtgtatactctctgctaatgtccatcactgactgaacacactcttgtccgttctctttcctatcctgtcccattgctttttctctgtcgtagtcagtgccccagaaacaccctcttcttcccaaatgcctgagcactccactggtagacattcatcttgttctaatttttttttctctttccttttttttttttttttcttttttgagttgcagtctcgctctgtcacccaggctggagtgcagtggtgagatctctgctcactgcaacctccacctcccgggttcaagtgattctgctacctcagcctcccgagtagctgggattacaggcgcccaccgccaccccaagctaatttttgtatttttagtagagacagggtttcaccaggttggccaggctggtctcaaactcctgacctcaggtgatccacctgcctcgaactcccaaagtgctcggattacaggcgtaagccaccgtgcctggcctctaatttttattaggtagatagtgctacaatgaacatccttatcgtttagcttttgtctttgaagctttctttataggatcaattctcaggcgtgtgattgccagacaaaataatataaacattttttgtggcctttcttcaaaagttgttctaattgtaacgctatcagtattgaaggagtaagatgctttcggtatcacattattcacagtgttcttatgtttttgtttttggttttttcaagtgctaagagctgtttttcttatgtagggtttctcaatccattctaattctattaacaatggctgagatttacaaaatggaactagctgtagaactaactgggttatatctgaagtctttgaccacagactaggatgaaactatagaaggtttcctgggcagatcactgtgaatatttaggtgtttaaagcagtttgagtatttatttaatagttagttggatagatttaccggatgcacacataataagttcatttatgtaaagtgggatatactgtttgaattattttgccaaaattatggcaaattagttgtaaatgtaaaatgcatgtggagaaataaatatcttttcctcctcatacccaaaccttccaaaatgcagatagatgatcaatccaatcaatcatcaaaatgtagacacaagtaacttccatacaatgaatattaatggccacaggcaatctaggttcattttgattttttaaaatccaattataaaacaacttgccataaacgcgagttatttcctaatcttttggttgtgtgttttttttgttttgttttgttttgagatggagtctccctctgtcgcccaggctggagtgcaatggcgcgatctcggctcactgcaacctccgcctccctggttcaagcaattgtcatgcctcagcctcccgagtagctgggattacagggtgcctgccaccatgcctggctaattttttgtggagacagggtttcaccatgttggccaggctgagctcaaactcctgatctcaagcaatccacctgcctcggcctcccaaagtgctgggattacaggtcctaatcatttttcccctttagtcaagtctcagttactctttgagttctagtgaaacacacacacgtgttcatatatagggatatataaacatatgtgtgtgcattgtgacttgggttaaaggtaaggctcagtgatggtccctgctgcaaagtaaactaggctgtattcagggccagctggattctttgttttctcgcccgagtactgactcatcaggaagccaccaccatcctcactgcagcctctggccctcttggatttggttgtcaggataagcggtggccatacagaagctctgctttccctgggctgccccccttatcaggagaccaacctattccatttctgcctgctacatccttttgctggataacctcctactcccctaagcccatgtctctggtttggttacatttctgtctctgtaataacaactctgtattctcagtctcaaagctttgaattcagtccatccttgcatatttgttgaatgcctcctggttggccagccagtctccaagctctttgaaatgtgaaatgtgttttgttttgttttcagaaggggtctaacttcgtcacccaggctggagtgcagtggcacgatcacagctcattgcagcctcgacctctgggctcaagtgatcctcccacctcagcctcctgagtagctgggactacaggcatggaccgccacgcctggcatttttttggtgtatgtgtgtgtgtgtgcgtgtgtgtgtgtgtgtgtgtgtgtgtgtgtgtgtgtgtgtacagggtctctcgccatgttgcctaggctggtctcgagctcttgggctcaagctgtccacccacctcagcctcccaaaatgttgggagtacaggcgtgagccacggcatccagccttgaaatgttttctatgagactggggggaaatcagtcaagatatgaatggtggtaacaggtggcttttgattttctctgtactatttttattttctgagttttcttctttgaacatttataattagaaaaaaaattagtaaagtgctgcctctttttttagggaaagaaacatgttttgtttgattgctttccattgccattcttacattgtttccaggccttctcatcattgcactggcttcctagcaagcctccacttcacactccagtccttttcattggtcttattgccctcatactagttttagagaaaagcatttcccatatgatgccgtccttgaaaatgtcagtatctttctgttgtctagtgaacaaatcctaattcctctatttaactctcagacctttcctactctggtttcataaccacccatagtttgctttcactatcatgaaacagcttctccttaccatttgtacctattatgcttataaataatattgttaccattgctactaacaaaactttgttcacatgaattctctcatttaatcctcaccaagtctttgaggggaacagaatagtcaggctttggagattttgcttttattattgtttaagtggatgaataatttatttgcgcccttaaagtccctcagctggtggaagggtttgattcctagtccagtatgcccaccgccacatttactacctcattcccaaatatgtagtttctgatacttctgctctccagcttcccaaggccaaacaacagctacttttcctgagtcctggatagaataagaaaaggtataacaagacaggggacccttgagggggaagaggaattagtttgaagtgctggcaaatgtagtatttctaatcagatgctagtaaattccatatgtatggcgaggctttcattacttagatttggggagcctctcagcgttttagcaatttgcaatcaggttgaatggatccattgtaaatacttaggaatacttaggaatccacgtcctggccctggcatgcttttcctcggccaggtgcactggcggtcaccttgcctttcattgtgccacgtgcataaaaatacaatgtttgctgtagggaaagataacaggagtgaaaatgtcctctgccctttgtttgaagtataggaccttcagaatgaggctgggctggttccttcagcaagcttgtgctcaaaggctgctatttctaccagcctgaggtaaacggtaataaagtacttgtttatcctacaagtgcattccttgcattgcagatttgatttcctttgatttcttgtcaccacctggaaaccttactttgtttcaggttggtacagttagaaaggtactgaatcttctgattcagacaagggcccagtagtggcaagaagagaggtacgtgtttgtgtgccacactctctggattatctattaaaggttttctcatatccctccccactaaccacttagaaaaggaaatcacctatcaggtctaaatgtaaaattttgcttatttaaaaatcactataggtcttccaaggaattatccattaagccaggaaatgaagtcacatccatggatatgaaaaaggaatagtcactgtaaatttatggctttgacagtggtatcttcgtagatactaaatgaggcaacaggatatgtttccacattaatagcatattgcagtcaacacatttactgggaaattgactcattttggtagtgatagaagtaaagttttgcaacgagtttaagagatacagctgtaattaatatattgccagcttgttcctttctcatattccatggaaacagccctgttgagagattagattgatttttacgaccttagtaaggccaagcctgccctggcagtgagtcacatagactgcctgaaggaaccttgaggattttctgcacctctcctttttcagatgagaaaacaggcccacagtggcacaatgaatctagtctacatcgtgcaatttacatcatgttatggcttcaaccagttcggagactagattgaaatgacagagtgttaatgtgtcaatgtgatcccctatatgaattttagattgtaatagaatgagatagataaataaacacccctcccccaaaacacatacatgcacacacacccatctttattgaaaatactctaatcccaacatagctgtttagtctatcttcagataaaaccaagtatcacttttaggtgggaaaactatacagtcatgtgctgaagaatgacgttttggtcaatgacaggccatatatactatggtggtcccataagatcaacgtaagaagagattataatggaactgaaaaattcgcattactttgtgacactgtagccattgtaacatcatagcacgaagaattatttcacaaacctgcactgccagtcatttaacaggtaaaaaagtatgttttaaaatatttttaattattatggacacataatagtactcatttatgggttacatgtgatattttgatacaagcatacaatgtgtagggtaacacaatcagagtaattggggtgtccatcatctcaaacattcatcatttctctggtaggaacattcccatttcactcttttagttattttgaaatatacaataaattattgttgccatgcatggtagcacgcacctgtaggaccagcgtttcaggaggctgaggtgggaggatcacttgcgcccaggaattcaaggctgtaatgcacaacaattgcacctgtgaatagtcactacactccaacatggacagcatagtgagaccctatctgtaaaaagatttaaaaatatattgattactatagtggccttattgtgctaccaaacactagatcatatttcttcttactgtatttttgtacccattaaccatcccttttttatcccccgatcttcactacatttcccagactctggtagtcatgattttactctatctccatgagttcaatttttttttttttttttttttttagctcccacacatgagtgagaacatgggatacttgtctttctgtgtgtggctgatctcaacataacgtcttccggttccgtacatgttgctgcaaataatgggatttcattttttatggctgaataatattccattatgtgtttatagtacattttctttatgcattcatccactgatgggcgcttaggttgattctatatcttggctattgtgaacaatgctgcagtcaacatgggagtgcagatatctttttgtggtttcgattttgtagtatcttcttcagtaaacattttaaggactttattgtttagataacgtcaagtataccaactttatattcaatatgcttcacctatgagagctggagtgtcaaaatctgtttattttacatctgttttctgcctcctgttgtacttagtattccaaatgagtaagttgcttttccatctatcttctgaatttctctatttgtatgacaaaaatgaataccatctatgcacagttgttgtaataatgtagaatgatatgaaaatgagaataaattacagtctcaactgttgagaacaagtatttctctgtgttagaaacattcccaattctactcttttagttattttgaaatatacaatgtattattgttgccatgcatggtggcatgcccctgtagtcccagctactcaggagactgaggtgggaggatcagtaacacataaatgagaaagcattccagaatatctggagaagtgactggcagagtggttaagtgcataggctttgaaaccgaactgtgcctgagtccaaatctgagctctgctatttgctggctgtgtgactgtggacacatttcttaaccttcctggcccctgaactcctggaggtgattgtgaggattaaatgaaccaatagaagcaaagcacttaagagctgtagtggatacatagaaggtgcccagtgaatgttagctatgattatctaaagtgtgttgtggcatgaaaatatcctgccaatgttaacagttgcttttatctataacaaaacatcatctgtggattgcattttagagattctggagattctgtttctctgcaaatgttaaaatgccatatcaggagacttttggctggttagacagcattccccgggtcaactgattacttttttttttttttttttttttttttttttttttttttttttttttttgagacagagtctcgctctgttgccaggctggagtccagtggtgccatctcggcacactgcaacctccacctcccaggttcaagtgattctcctgcctcagcctcccaagtagctgggactacaggcacgtgccaccacgcccagctaatttttgtatttttaatagagaaggtttcaccatgttggccaggatggtctcaatctcttgaccttgtgatccgcccacctcagcctcccaaagtgctgggattacaggcatgagccatcacacctggccgattccattttattaatagattttccatcctgaaagtaactcctaaaaaccctccttcacttaggtttcctttggctttttgtgtattaatcagactgtgggccctttggttccatagacattccttttacaccccttttggacggatgaatactcactagtaactaagtaattagtaagagttactacaatttggtatttataaagaggtggcctttcccagaattgaaggtagaccctaatagtccaatcagccttccatagagatagctggctgccatgaaaagctgagagatatcaccgacctcttactgggcctgctcatgaacagttagttaaaattcctgcaattttcagaaaagacccttatcagagtattatcagtattgtcttaagtttaatattggtttccagttgttatttttaaaaattttaagctaccgtgggttaagctttatgatgatctgtttaagtggtttgtttgattaacttctctattggagtaatggatgttttcttcaccagaattttgaagataggtttgtgttgtagttgaaacctgttttgtttatacacttactgctaaggaaaagcacatgtcattttgttttccatcttcatccttctaaagtagcacttcattgttatgaccaaatctttctttcttccttccttcctctcaccctgtcttttccttccttccttcctgccctccctcccgcctctcttcctttcctctcctctcctttcctttctttctttcttttctcttttctttcgttctctctctctccctccctccctctctctgtccccttctccttccctccttccttcctttcttccttccatttctatcacccctaaaattccatcatgctgtatcatctcactaagtcccaatctctggaaaccacagctctgttttctgttcctgtaattttgccttttcctgaactggattttaaaggattgtaggaggcagtagtggaagagctaactttatatcttgttcttttacataatgcgccctgatccacacttgggaaagtatattccatggtacctatagacagatatatgtgctttaccatgtatatgtgaaacttttctaatttaactttcctgttaaattagaactcggtagcataaattaatactgttgagtatacttagggatttgcatagatttaaaattgtgcatatgttccctagggccatggcgttaattggtttattagtcaggtggagtgcagagcctgaggtcaggacagttgtccttgaacatggaaatgaagagtggataatcaccatgtgttattgtttgggctgattttatctttaatgggtgattcagagtcctgattaatatttagagcagtgactgctggcctcctacctgctcattatcttcagaactttaaataaaatacttgatttctacccaagatggtagttatgggaagccttttacttcttcttgtctcacaaagacaactcttgacctctcaatccttaaacaaaaagttctgcttctgcgcatgtggggactcttaaactcattttcatgcctggagattcacatttagggatctaggaaaagcacatctaggcagagtcgatgaggagatgctttaagaaccgtgacaaggacaggaaggaaatcaattttgcgttaggtttgtatttttagagaaaacgaatcctggggaacttttcacactcattactattgacattaataccattgtcctgtccctttcacagttactaaaatcactcttgcccaccctcctgccttgcccacaacctattcccatgaaggggtgacttgggagaaataacggtttccaaccaacgttttattttggaaacatttcaagcacaaagagtagttgaaaggatagtctaaagaacactcatctgtgtcatacatctgttcaatccatggttgcttttcgctctacttacctcctccaccctctcagctctgtttatgtatgtgtctgtctgtgtacatacacacacaaacacattttcccctatgccatttaaaagtaaaggagcatcacaacataaacccctaaacacttcaccatacaccattttcttaaaggatgacattctctaacataactgcaatgctatcgttacacacaaatttaacagcaatccagcaataccctctgatatgcagtccacactgaactttccccagtgccccagaattgttccttatagccactgttttcttccagcatctagtcaaggtttttgtctgtcatgtctctgtaccttcatttagttttgaacagtctcccagcattttgttttcctttcatgacattgacttttttggtagggggacagagtctcgctctgtcacccaggctggagtgcagtggcgcaatctcggctcactgcaacctctgcttcccgagttcatgtgactctccacctcagcctcaggagtagctgggattacaggcatgcaccaccacacccggctgatttttgtatttttagtagagacagggtttcaccacgttggccaggctggtcttgaactcctgacctcaggtgatccacctgcctcggcctcccaaagtactggaattacaggtatcagccaccacgccgggctgacgttgacatttttgaagagttcagaccagttctcttgaagaatgtcccatactctgggcttttctgatggtttccttgtgattagattaatgttaacattttttggccaaaagacgataagatgatgctctgtacctaccactgtatcacaatctggaggaacaaaataacattttgttcctattggtatcactaagaatgttaaggtggtgtctacaagatactttccttgtaaaatatccttttccctttgtaatgagaaagtaattttttgatattttgacatattataatatccattccttaaccttttaccctatggttttagcatttatggatgatccttgtctaattcagttataatattggtggttgcataatggtggctttctaattctaccatactttctgcatgtattagaccattttcttatgtaaagaagagcttctacctctcccccgtctattcatgaatatcactgtggacatccaaggtggttctgagtgtacaaagaatgatatctctctttactgaactgccattggatactatttttgtcttggaattgtttaaaatggcagtgtatggaattgaaagtcctttctccagagagccacataaacagatgtctaataaatacatttccatattaaccaatccttttatgggaacaacacattgacataattaaaacacgtaacatgaaaactgtgctgaattgagaagctcatagagttttgtttcttttttttcctttttgccacttcaatatatatggacccgcacctgtcagtccaggtagctcatacatgccgtagcatctaatggtacgagggacatgtaatgctgaaaagaagggggaaaggagttgatcagatgagatataagtatgcatttatcagtgttgtggggtattcacttgcaccttccattggctctcgcagccatgttatcggcatataattcagttgaagatttatattcacctggaaattgtcctaagtgggccttgcttacttagctatcagactctagtactttcaaacaaattaaagattcaaaagattttggggatcgccttgctttttcccataggaaatcacttttgtcctgtctttttaagactattttaagcatatatttcagtattaaaatcgtagataatcttaagctgtttccttaacctctttgggccttttcttatctgtaacataaagttaaaacaggttatctcaaaagttacttatccctaagtgtctttgattctatgctaaatgttataaaggccgaaagggaaatggattattgtacttatttcaaagcttggccatgatcagcaaagtcttacctgatcttccgggtaacaactcttgtatcagagctataagatatagaaaacagtcttgtacatagagtgtggcatttcacatgagaccaagtgttctctgaatggaaacacacactaagagcaagatgtgaaaaaccattgtgtacaacctcatgtaaatgatcccttgcgtccgtacactatagtttcctcagtaactcaaaggtaaaacccaagtatcttgtgtctaagaggatcaaaatgtcaccttccttctgttttatttgttacatgcaggttttgtatagttttatagagtctttttatcactcatttgattttcataaaaattgggattgtttggaagaagagtcattaatattctttacagcttgttcttgttcctccttttatgttctctgctggtgcagacttctctcttatgtaaaatattccactgatgcccttggtagatttagaggttgttaaagaaattgtaataacagatcagggaacagtcagggactgcctgtcctatactgtctgaccctgactaaccgttctccttgtagttttaaatctttgtgtacagactgtaattcaaaaaacagtttttataaatttaaattcagcaaatctttccaaatgctaaggctttttataacgagggctagaaaagttgagttgtcagctattaatgccaatacctattaacaatggcaatgacattgaaatgattttttggatttatgaagggaacatgttactaatgaaaatagcaaatgaaaatggccactgtattagtccgttttcacgctgctgataaagacatacctgagatggggcaatttacaaaagagagagggtcattggacttaacagttccacgtggctggggaggcctcacaatcatggcagaaggcaaggaggagcaagtcacaacttacctggatggcagcaggcaaaaaaagagcttgtgcagagaaactcccgtttttaaaaccatcagatagtgtgagactcattcactatcacgagaacggcgcaggaaagaccaacccccataagtcaatcacctcccaccaggctcctcccacgacatgtgggaattgtgggagttataattcaagatgagatttgggtggggacacagccaaaccatatcagccacaaaggagagattaccctttttaaaaatctgtggtttgcccacaatgttttccataaatttacctttttctgtcaataaaaatgtttaggaattctatttatggatatgtatgtatttaatatttgcatatttagttcttattttttctctaaatggttatgacctgtactaagtaaaatcaaaacacacacacacacacacacacatacacattgtactagcagacctgctttaccttgcttgggataattatctgccatgattaaataaataaatttctgcaactgtttatcctggaatacactgcatagagttgtcagtttgagaagcaacttgatttcaaatctgagtctacaattttagcgtgtttccttgtgacttctagtttggggcttttaatttcccttttgctctctctaccctcagtttatgaacgagtgtggcatttcggcagttgaataggcctatggtagcctcccagtttctgtgttgtagaggatagttgccggcttattaaatgcccttgcaggactctcagggaagtctgttgtttagtgaatagtgatgaatcaatgtggatttcttagttttgacaagtgaaccatatggttatgtaagatgttaacattggggcagggtttctcaaccttggtgctactgatgctttggcccgaatcattctagttctttgttgtgggaagctgccctgtgtgctgctggatgttttgcagaatcctggcctctatctactaaatgctagtagcaccccctccccgccctccccctcccccccccccccccccccccgcccagttgtgacaaccaaaaatgtctcccgtaaaagataccaggatgaaatcactttttgtcagtcccaaactaactagagccagggcagcatgaaaggaggagggttcatggttacatgcctgagataaagactgtctcaaggactttctaaaatcgccccacaagaaattcctctgttaggactgcagcagtgcacgtaatatgctctcaaaagaacatctgcccagtaatggcatccccactaataaactgacaccagttctggcgttgagcatctgaaacgaactatgtttccaagcagcttatgtaaacttctgtttttaccaataaaagtttccctctacagtctcctcttcagatgcatcttgggttgtaatcctcatttctaattccaaaataaatttaacatatttggcgatgtttttctctgatgttttttggtcgacactccaaacattgttatatttcctctggggtacggcatcatttccggttgagaaccaccgacctagagaaaagctatctgcctgtgcagttcctttcaagggccccaagtgtgaattttgtgtatacctatattttaagccagatcattctgtacataccttctaagtccagatgaagtctgttagccttttatgtgtgataccatcacatagaaaccaacacaaggacatttactgtaatcgataaaggaaattttggacagtttgagaaagtaacttattttgtcttctgctctttataaaatctttacaagtgtatgtttttgctcttcaggatgactaggcagctttttaaaattctgacttcatacagattttataatcttccttttatttcttgcgatcatattgcagttgaattcccacccactgttcaattcagcagattttaacagagactccagaagtatagttcctgtctttaattaatctgcaatttaggaaagaaattaaggaggtatcgttctgtattgtttccaggatggtggtttcttgttatctgagaattactgggcacagtctcttgcccaatgtttacttctctatatagagttgacccttgaaaaacatagatttgaactgtgtgggtccacttataagtggatcgttttcaaccaaatgcgtatcgaaaatgcagtactcaagagatgtgaaacctgcggatatgcgttcagctgggcctactgtgggacttgcgtatgcgtggattttgctgtatctcaacagcaaaatccccgtgggagtggggctgcggcgggccaggaagcaacccctagcatatactgagggatgactgtactaattattgtagtttattaagtgttcacatggttttcacaaacctcacaattgaaatgccaattgccttctcctaaaaaatacaatgtacgtgttcatggtagctgggatgcagggcttgctgagaaatacttaattgcatttcttctgtagccatgaattgattttattaccttgagagaaaaatgagtattcaggtggacctcctggcaggcggttggcccttcagtgtccaaggatttatagaaagcacaacatcaaagaaatccaaaagttcttcggaaccccagcaactctcctacctccaaacttgccatgtaatgcccttttaaacttattatattgataggtaaatcggtttgctagaaattccagatattgagaattctttgtctgtgtaccttgttatatttgtataaaggtgatatttgtatgaagccaccctccagtgtgctgtaacagagcaatagtaatgacaactgattccttcccctagcttttctgttatggatagttgctggcaggtgaggaccaacagaaaaagaggagaaacccaacataattccaaactgtgaccatcataatggaaggagctgtgatagctttgctttctgtgtgtgcatgacatagaaggggaaaatggagttattgccaaaacaacagcaaaagcaaaacaaagccaacaaacaaaacaaaacccagggctaaatgacctttccaagagattttgcttgcatggcttgaaactggtgtttagagatgaggacaaggtcacccttgatactgagaggggattatatctgagacttatatgtatctcaacaaataatggtacttacaaagattatctcagtccagtgaatgccatcatacttatcttttgaccttaataacttcctgctattccaatctatccctatatatttttttctggaatgatcgaaatgtaattttagctgggtttaattctagttctgttaggtctttacagaagcttgcctggcttttaattctttccttcttcattgccagacaaaaggagagggaatataccactaggatacagagtagtttgtcataaaaatgaaagattgaaacagaatgagaacgtgaatccccgtaccttgtcttcagtctgtcagttggcgtaggtgagcagttttaaaagagccaacatgatggatcttgcatcttaggggctagaaatttgagaatgttcaacctttaagcatagaagaatctatagttttttgaaagagtagaacattctacagcctcccttggtaattcacactaatgctttaacaactttcagcatcaggaaattcttccatatgagctacagcctaaattcttcatgctgcttaagtctgtttcttcttgttctgtcctcagtggagagatcgaacagctggtcacaggcccctatgcgagagccattcacataattgaaaactgttattaaatcgccccttcagaagtcactcttgcttgttctctctctctctctctctctctctctctctctctctctctctctctctctctctctctctctctctctctgagaatctgggaagattccagagctgattaacatgttgctttactgatgaccttctcagcttttaatatgttaacgtgctctaagaattttaagaggcagatataatgtgcactgtttctttcattaatttgaccttctcgtgaagcattttgctggacgattgatctgctggacatactgggaaacactgactcagagattttagttgagtaggaaccgtgtgtgagcctacggtacagaacaaaagaaagtaatccagttacactgtctggagaaatagaggtacattctccgcaatcatatttgaagaatagttttctaaatgacaatggcaaactaagccgtgtcatatgaagaagaagtaaaaagaataggaatgaagaggcatggacagataagacagctctggtaaaatatttaaagggctgttcaaagaccaagaacttctgggttgctggtcagatggataataataatgacaataacaatagcaaacatgattcttgctatgtgtcagacacggttccaattgcctttcatttgctgactcacgtaatcataaaataactctatgaggtaggcactattaatatttccagtttgtagcagagaaaaagtaagacacagagagataaagttattttcctaaggtcacacagccagtgagtggtgaactccagtggtttaactctggaacttctatatgctgtgctgatggatttcagctcaatgtgatgcagcacttttgacaggggtatctggacacaggtgttcaggatcaccttctaaggatgtttcccagctctctcacatgggtggtgtagtggctgtaagcacacactggcatgggtaagagtttggactcgatgaatgctgagtttggactcagtgaatcctgaaagtcttacagctctgtggtgccatgccaaaaggatgaatggacttgcatgatctttttcatttttagattgcataattctttataaacttttttttccacaaagtacctctgtgatggaactctacacagagaaaagtgctcagcaacagctttttaaaatttaacttgtaagttcaggggtacctgtctaggtttcttatgaggtaaacttgtgtcatgggggtttgttgtacagattattttgtcacccaagtattaagcctaatacccattagttattttcctgatcttctccctcctcccaccctccatcctctgataagccacagtgtgtgtttttcccctctatctgcccatgtgttctcatcatttaactcccacttataagtgaaaacatgcaatacttggttttctgttcctgcattagtttgctaaggataatggcctccagctccatccatgttcctgcaaagaacatgatctcattcttttttctggctccggagtattccagggtgtatatgtaccacgttttctttattcagtcttccattggtgggcatttagattgattctaggtctttggtaaacagtagcatttgatcggaagtttgaactgataccattttgcagctaggaaatccaaagttaaacagtttattatagtgttgctaaatttagaattaggggtaatgactggagtgctgttgaggtgatcagtgttataagccaaatgacctgtcagtctaaaccctcctgcctttctatctgaaatgtggatatgtcctttattaggaaaccacattacaagagaagcaacttggctttgcagctcaaatacccatgacttgtgtgatactaagtattcccatgtcatatattcaactgaaattggctgtggaataagtaatgcttcttggttcttggcaaaagcaaaggagaatcatctctggagaaagcacttttattctaggctcaagcttttatttatctctagaaaatattggtaaggtcagtttagtacgtggtaaaaaaaaaaaacaaaaaacatattaagcacacaagaaatcaaggtggaaaaagaaagaaatcaaggtgaatgagaaccagaagaaatagcaaaccatagaagcagacctacgataacatcatattccagaattattagacagattattttcttaattgtgtttatgcagttagaaaaataaaaaacaacattgaaaaatatctacagggaaccacaaacctgagaagttaccttaaaaatgaccaagtagtatttctagatgtcaaaagtacaataatcaaaatttaaaactgtatgggtttacagcagaccggcaagagaaatggatacccagacagtaaggcagaaggaattaataagaatgaagcacagaaggatgttttaaaaagatgtggggcagagaggggggaactagggaagtcctgttcagagaaatatagattgaagaagagtaacatttatgtaacagagttctgaaagtagaatggagagggaatggagaagaggcactatttgttgagagaatgacggagaagattccacagctgattaaagactctaaatcacaggtttaagaagtccagtgaatcctaagcagtctaaatcaaatcctagaaacagcacaagatagaaaacagatagattatctttattttttttattttatttttattatactttaagttttagggtacatgtgcacaatgtgcaggttagttacatatgtatacatgtgccatgctggtgtgctgcacccactaactcgtcatctagcattaggtatatctcctaatgctatccctcccccctccccccaccccacaacagtccccagagtgtgatgttccccttcctatgtccatgtgttctcattgttccattcccacctatgagtgagaacatgcggtgtttggttttttgtccttgcgatagtttactgagaatgatgatttccaatttcatccatgtccctacaaaggacatgaactcatccttttttatggctgcatagtattccatggtgtatatgtgccacattttcttaatccagtctatcattgttgggcatttgggttggttccaagtctttgctattgtgaatagtgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgttttttgcaaaggagcaacagtcatctttactattgacttctcagcagcaacagagatagacgaaagtggagtaatatttcagtattcaaaaacaaaataaaaacaagaccccaaaacctttcaatcaaaaattttatacttgggccaggcgcagtggctcacgcctgttatcccagcactttgggaggccgaggcgggtggatcattttaagtcaggagttcgagacctgcctagtcaacatggtgaaaccccatctctactaaaaatacaaaaagtagccgggtggggtggcgtgtgcccatggtcccagctacttgggaggctgaggcatgagaatcacttgaacccaggaggcggagattgcaggagccgagatcacgccactgcactccagcctgggcaatagagatagagtcagtctcaaaaaaaaaaaaaattgtatttaatgaagataactatcaggaatatggattttttttttaaaaaaaggaggtattttcagacaaacagagcttgagaaatgcaccaccaacagctaaaggaaattctaagggacatatttcaggcagaactaatcccagatggaagatttgagatgaaagaaagcaatgaagagcaaaaaagtagtcaatatataggtcaatctatctaataatataaaaaattaaaacaatcctatagggttgaaaaaaacaaggtataattaaaattcatgaatatagtaacatataaatcaaatggtggtattttgagattgttgagatcattgtcctgtctgggatgaattgtatttcttacatttagactttgaaagagagagaaatagagaggcagacagaatcaacagggcatcatgaaaacagcgctaagccaggaggtttggattctattatcagctctgctgctagctgtatggcctttgaaaagctccttttctggtctacaaaatcagtttgcttgtctgttagatgaggctttggaaccagatgaattttaaagcccctcattatgattctatgagaaacagattctctagaaaaaaaaatcagttgtccccctcctttgaaattttatcagtaaacacctgcatttcacttctggctaacttttatgtatcagttcaaaaattaaagctaaataaagtctcgctcaggtgtgtagtttgcttacctttctcgtttgttggttttgttttcttttcttgtcatctagtagccaaaaagagtaatggcagtttaccaaagccttaggagtgggtagctctttggatatcagggagcatttgcagaaacaagctgtgaaaagccagcctagctttgcaaccattgttctttctatcttttctgtttaacttattaatcgaactgatatacacctcctttgccatcttgccttctttcctttcatccttttgccctccttctctctccctcctgtctttgcaggctaataataagccagagatcgaagcggccctcttcctagactggatgagactggaaccccagtccatggtgtggctgcccgtcctgcacagagtggctgctgcagaaactgccaagcatcaggccaaatgtaacatctgcaaagagtgtccaatcattggattcaggtattaggaaccaaaaaaaaaatgtcatttttttctcatcatttttcacctttttatgacttgatcttttatctcctgtgccagttgctgttagttcgtaccgtctccaaagtgggagagaaggtgattgggctggaacatcgatcattcctgtcaccctcctgatcgctaggttattttggtggatctcacttattaggctggtgtcccttaccaccttcactcttcagctcttcggagccacatttttggttgagcaggccaaagtgcgtgtcttcacggaggtattacagatgaactgtacctcctccttcctggaaccaaaacatttttaccatctttcctttttcacggtctttcctgtttatagaaacttcccaagaatcagttataaaactgagagatgattctattctgggaggaaccataatagtagctcagtctctcattcactttgcaccatttttttttctcccttaagtaacaagaattgttttcagcatcttagaacttgcttctttatctgtgaatctgattacattctttgtatagtatcccagtgaacttctaaaggaataaaaagtaggcaagtaaatggaagattcacaaagcagctaaaaaacaaccagtccttatacatttagaagtgaaagagataggaaacgtagcaggttattctgatagtcttaaaatatcatggaaaacaaggccaaataaatctttagccctgctgacctgtttggggagacaggatttttttttaaatgaattaatctcacttaacattaatcctaaatcctaattctgaaactgcgatgtccttaaatgtgtgaatcaacatcaaggtttctatagtgatgaataagccacaaagttgtaaactagctctatggtctatgcctgtgcagaatccacttagcagcaaagtaaacactcttttccagttacgtgtgaactggttttgttactttattttctaataactaccttgtactgttgcgtgctttttattcatagtgcttttttacttttggtgtttattgttccatagtcatgctgtttacaaagaggttttacaaaaacttttagaggtttctgaagcctagatagacaacagtgagtaggtactgcttgcaaaggtcaccttctttccttcccggtttcttggcaggtaaaaatgataccatgggggtggggagtggggaagggaagccacagtgactgcattagatttctaagctaccttttctctgcttccttagctagtgggctttgtatacaagggaaatttttataaaataaagaagaagaatgccttggaggatctgaaagagcactttcaccttcaattcttttgcccttatcatattatattattttaggacccagcacttctcattcctcctgtccccctcttgaaagatggctggaatctaaaaaagatagctttccttcccacttccccatatgtgacataagaaatatgtttatttgaattggctaaggttcttatctgagaaagcaaaaggcaggagagtatgaaacaaagaatatcgcattctgataatggaggaaatgtaccaactagtatttacagattataaattcttccatctaatccaaatttcatgttctcttggggcttcagttatcatttgtaggtaatggggtgagagatttctgaagagatagagataaaagagttcattcgagtaactgtttgaagatgaatcgtatcagtcaattagaaaacattattaaagcgagacttgttttaattgaaagttcttgttcacatttcttttgtcttgtgaaattgctttatcttgacaatgttttgaaaataattgcttcagaaaacttttgtcccatgatgggtaaggggcatgcacagcgtaagtctgtcgctcctggaagttcttttaaatttgagtatttggttttcaaaagactggaaattttccagtaccttcctacttaatctcaaagagttcctagtggagtttaaataaaagctgagtttttcttccctccttccatatgtttataggataatctttctgccaaaatgttttggtactgtaggagaggcaccggaaaaatctggaggcagaaagttaatcacttaccttgtgggactaatgaacattgctttctgtttctcaaattagaacgtggtagaaggtttattaaagagtgttctttgggaatttgattcgaagaaatacatacgtgtttgtttttgctctttatcaggtacaggagtctaaagcactttaattatgacatctgccaaagctgctttttttctggtcgagttgcaaaaggccataaaatgcactatcccatggtggaatattgcactccggtaagtttgacgccagcctgacgtgagagttagttcacctgggataaatttcagttttgtacaatactgcagatcatgtataatgctgtgatttgtcacttccccagatgttccccagctaaagtggctctcaactgtaggcttcaggatttaccctatccctggtgcctaggggagtgcctggcacatatggaacatgatagaccctcaataaatattgttggatgaataaatagggttttcattctgtgtgcatggttgtattgaagacgttttcacgtttattttgcacagccttagaggttgtgtggggcgatcttatggccatgaggcatgttgagtatgggggatggttctaggttcccccaaattcataaactaccacttttaatcaatgttgctcacctattatctgtcctgtatactagtgacattttaaaaatccattttatatgctaacacttactaaatgctaggcatttaccttttaaactaccctgtgtaaaataagtactatgatttttatcccctctatacagatgaggaccctgaggtcctgaggttaaataatttactcaaggttctataagtaagagttgaagccatctcctaagatgttattttaggaaaatgttaagtggccaatagaactgtgaaaaatcactagggaaatggcaaggatgtagacttggtggccagacagacctgagtacaaatctgcctaagaattaaagacaggctcctctcaggtttgttttttctaaaataaacctgtccctgttgactgtagagccacccttcgtgtttctcttctctttctttaattcttacagtctcctcttctctaaactttgcatgcttgctattcaagatacggtctgttgactaatcatcatatgtctattggcattaccttggtctttattagaaatgtgaaaccacaggccccaactcctgatgctctaaatcaaaacccacattttagcgagatctgcagctggttcccatacacaacaaagtatgagaagctctgctttagagcatctctctcttccatcatcagagtgatcctcccagatatttgcctgtctcacttttattcctcttatagagatggtcagtgattgagaatgtaccatgctatgaatagaccgaaatttagtgggtgaagcatgctatcattttgtactaagtagtttttaaaataccataaagtgtggtaaaatttaatgtcacctttttgaccttaagacctataaactaccatttattgagtagcctagtaagcttgtatgtttcttttatttatcataacaacgtgttgaggtgttgttgctcccattttactgatgatcagagcctctgagaagtaaataactcagccaaattagtacatgccaggcctggtttcagagccccatttgtctgattccaaagcctttgctcacaaccacaacactctccttaattacaaaacaagtgtcatggggcagaagactggagtggtcattagttttgaaatcatcctgtcctaaatctgatctcaccatgatctcccttttagactacatcaggagaagatgttcgagactttgccaaggtactaaaaaacaaatttcgaaccaaaaggtattttgcgaagcatccccgaatgggctacctgccagtgcagactgtcttagagggggacaacatggaaacgtgagtagtagcaaaagcagaacacactcttgtttgatgtatatttgaactcctctcagctgaacaccctccttcactcccaaatgcaaacagtctcttctatttctttctttttatttacattagctgaaaagagaaaaataagctgatgtccagttgccactttcccacgtcacttgacaatttctttttccaaaagttaaactttatctcacagggggaaaaaaaaaaaaaaaccacaacacaatacagccactaattgccttacaagccttataagaaatatgggactgtttacaaatgagtgattccagtatttcattttgattttcctctctcacaaatcagtaaatgtgtgtctttttgtatctcattgtgtggtcatatctagtcacttgtttctactcaaaagaaaatatagtcacaggaaactacttcacagtaagtagtaatgattctcaagatcaaaggggacgtcttcacctcttttcaacctgctcctcttttttgccttaactctgatggcagtcacacaactgtgtgtttttcttttaattcactttacaccttggtttggctattgctttccatggttcatacttaattggctggattttatttattttgacctttcagtaaatttttttgcggctgagtttgcgtgtgtctccttcaccacctcattttttgttttgcagtcccgttactctgatcaacttctggccagtagattctgcgtgagtactttttttgctgaagggtgctgctaccaccaacacattcgctcgcttggttctcttttgttctgtttatttgtttgttttcttttgttttgttttgttttatggacatattaattccccttccttcatttcagtttttttttttcttttcttgatgagactttgaaagtaccatctacacagatcaggagaatcagagtgggttttttggttcctccaccaggtgaaattcaaaccagcagaaatcctggcttgaattcaaattataatcaaagaagttattggagttttagctgtattcctgggagacatgtttatatatttcttcatataaaagcaaggaagaagcttctgattacataataacattctttagccatatttcttgagattcgatgctttttagaatctttagggtctgttataagtggactattaaaaatcagcagaattcgttttaaagtatgatgctgagtttggttgaataattttaatgaggtgtgcggactgtttatcaggttatgccatgctatttgactaatcattatatacaagggtttctaaattttgaactaaactcactttgctctcctctccaagctaaatattcagctcataaacaattatacatttgctctaggaggaaagtatttctttgttattactattggtgtgtattaataatactgagcttagataccagcagatgatttatctcagagtttataatgctagaaaactcttttttggggcctgtgatttctatattagcaaacaaagtgcctattttaaaactacattatgtagggttgttataacaaacttttggtatttcaaagtatgctttattaaaatatttattgaaaatcagacagctctgttatggataaaggggaaatgaccaattcggaagataagcttgtgtaagaattcaatttctttttattaaatcttttttattgttccaccatataatttaatctaaactagatccttttttaaaaaccctgtcgtgataaatgcatattattaattgaggtttattttcagtctttaataggcctaaaggaagtggaaggctatgctttcctttttaaaacttcgttattgcgccccttaattttgagatatggtagctataagtagtatattatctgatttatttaatcatcatgcttaaagaacttagggagttatttaggttcagttatgtcctctgcctcttggaaattgtgtttcctaacccaggtagtctgttatagaagttacaaccgttcataaataagaaacttttaaagagttgatacactacagtttcagcttgattggatcctgataagggaatggatttactctatgtggaaataagtttaaccgagtaagaaatccaaacgacaaatatgctaaagaacagttgttacaaatacatagataaaagtagcaccaaataataaacaaagagtaattaatagtccttgaaaggcaaaaaggagctacacgtaagctaatgagaaaaacattatgacaatcagattaacttattttaagtagaagattttgtctgtcttaaacgttgaaagactttaaaattaataacatcttttatttaaaaatattttctaacaactaaaacacacctcccaatttgcctttttatgaagagttggttagattattcagaaatagtgggaagttttaattttgaggaagaaaacaaatctagcagactgaagtctgtgttttctttaatagcagtaattgtatttaaagtatttattcataggattataaatactgtataaaatatattacaaagccatcctattcaggcataagagccaggtcctaacgtgtttcattttgcaagacttgtatctaatgttaacaaatcctatgatgattacaatatttgatccatttgatatggatcacagaatttgaaagtttccagagatacagaccgtttggttttccttagactaaactcttatttgcttgtgtttgtcatattactttaaaactaaagctaacataggcctttacgttgtctgtccataagtgagccagtcaaacgatattctttgagcgattctgcattgaaacctaaatgaatgtcagcttttaattaatagagttttcataaaagagaaggtggtggtgggtgggatggaattgaccaagtaggtcattaactcttatagtaagtaatccttctgggtatatggttttgtgtttaggaagtgggaagcggggaacagtattattaccttcttttggaagtgttttagaaggctttgcacttagttttgtttgtggactaagtggctttgtattttcactaattcttggtttttaaatgattcatctctgaccagtactcccttttggctcattttctggtttaataaatgtctcttttagtgtatattttttaagatttctggttattgtaagttcttgtgcttatgcatgctgtgataggcgccactgatattaataagaaaaataacatggaattatccttgaggcaaagaattaaagctctgtataagattttctgtataaaatggtattaaagtattttggatttatatgcctacttttcttggtgtacttatgctccaaggtcttaggctttcattcttgtacacacttccaggatagcaactattacaagggaaaacactactaatgtattttccctgatggtaggctttttgcttattaaaaaaatatgtaattgaaagactggtctgttccaaaagatagttcttataatacaaataatccaagtattaatttatcttgatctgcagtgaagatttcaaaacagaccttagcatttttctaataatgggctatgccagggttctagaagattaacagattaactctccaaaactatagtgaagtttcacatggaaatctttggatctgcttattaaattgagtagtcatcgttttgtttcctcttgacaatttaaacgtctttataactcatttcaatttgattatgattacacttgacctagatgacattggtttcataaataagacctttctctctcagggaagaattccatttccctagttatttgctatagtgtgtcgtaattatcttactgtagtatattaagaaatatgaatttctggcacattttctaatgcaagcttagctactggtaactgcatctttttcttttttaatgtaagaagaaacaaacacattctccttagtgtttcaaccaagtccttcaacgctacttggacactgggctaaaccagggtcctctctgaattacattatcgttgacttttggatttatgcctttacctaagggctttctgtgtcagcagagaaatggaagagaccttttgtgctattccaattaaaagaaaaagtccaagcctaaactggttttcagaacagatggttttttttcctaaggttaatccaaaagatactataaaaacttcaaggataattaatagatcagatatgaaaggatgaaaaaatgttaaccctaccagaattctagcctatggagataagaaaagataggtgtttatatacaaaaagcatatagactattcctgctaatgatctcctcttattttctcacctatgttttagcacacagtatctctaagaaatatttcagatatcatgacgttctatgaaatttagtcattcttttttaaaacctcacaatataatccagggtcattctattttgtgctagaaattagtggtatagtcttgctgctgaattggaagatacatttcttctttacaaaattgcatagatcaagacatcttgatacatggagttttaagaagtcttgtactagagtagcctctttgaagctaaaataattgtaagtatctaggcagatatacagctttgatccaataagaagatagcctataaatggcgcaggtgtaaactatttaaaattttaaaccacatagggctaacacaatttcggaattataggatgtgagaaattacaaagtaggaggacaaaatgcttcctagaaactgtctcccccaaccttttctacgatgggaattttccagagaagattttggcctctcttcatggcttttaataaaagcagaagtatgagaaatcatctctcaatcctggattttaaaatacttgataatatttaagatataggagcaactaaatgtatacattatccatagaattagaataaaagcattctaggccatgtgtataacataactgtgtggtgggttttttctccattaatggatggtatctgtgactaatcacattttctgccttataggcctgcctcgtcccctcagctttcacacgatgatactcattcacgcattgaacattatgctagcaggtatgagactagttgtatgccaggcaaatattgattgaaataactaaccaaggaaagctaacctatgatattttaaacaaatcttttctttttttccccaaacttgtctgattcctactaatcaacttgccctctaacgtgcatgccgttccactgcatgttgtttttggtcaccaacaagagcattagtccagaataatcttccctaaccctggcttttaaacatttccggtagccttgctatgtttttttatactgagcacatttactaaattggcttacaaatagtttaacctccttagaaaactgctagaccagacattcatatatgaaaaaatgatactatattatatggagaatatgaaagcatcagctttccgtttgtgtatttattttacatgatatgctgtaaagaagagaataattaattttcctaatccttggacttttctgtctcaccttctttgtgtttgagatgatttttatacctaaaaactgaattactaattttaaaatattttatgcttgttaaatccgtaagagtttggttaacttttttagttgtaaaaaaacaaacaaacaaacaaacaaaaaaccccctgtataattgcctgaggtgaagaagattttaaaggtaaaaattggtggcagaatgtttagagagcttactgtgcatccatcctttgtcaatattctaactgctggacatgtttaccaatcgtgaaaagcattagctagctgtgtaagtctgtcatcagtggaaagtagtaattgtcctaaaagacaaggggtagtgtaaggtagggagtgcacttattgttagggaagcttttcttctgaaaacaaagacctgttctcagtgaaagcaagactgatctgtagggggaaaacagtgaaatataactttccttagaatttctatcataaatgtagtgctactaactagctgtggtctaccacacactgcctcaaatggttaagccaacacacacatcctttaatttgaaggattcctttctcttcttgccatgatttatcctttagttttcaggaatgttcgattaggtcttgaatagattctaagacgtcacataagttttaatgagcttttacgttttttatcaggctagcagaaatggaaaacagcaatggatcttatctaaatgatagcatctctcctaatgagagcatgtaagtatcccatctctttttacaaaatgttcctgacaatgaaattgctttgagggatttagaggtaggatagcacaggatataggaattagcatcatattcatttgatcttttaaggagccattcatttacttttttcctttaattcttaatgccctggcatggaatgagctcatccaaattctggcattattagtattcagagtagcaaaaatagtttgccttactcttatttgaacttatttcataccatatgattacaaattgcagagtcccaagtatttatagtaatgcttaatctttgaccaaacctgccagatatttaaagggataggatattaattttaaagtcatggctaagtactattttctccactcatggggagtggaaacgtgatcttggtatagcatggctattcacatatggtaggttagttgggcattttccttcagaaatccaaagaagtagatttttgtgatttagcatcttcacaagataaataaagtgaggcaatcttatgaagagtttccagaggagaagtaccaattcaggttgcaggttgttagcaggatgataagccaaccctgttaaactttaaggacggagatagagcggtgctaagagcagcagggaacacagctatggcagggaaacaggcttcattatagagtgagggcagtgttcacaatacagagcacaaaggaacattgccatgaaccaagtaaatgctgaccggggcttgaggtagagagagcagacattgaagcaaatatgaaggaaaaaataaggatttgccaagtgaataaataacataaagagaagaaatctagtcaaagtattacgatgcctttttagtttgataaagtaaggatatctcacccatcttggagaatatagacaaagggaagaatggtaaatttatcatatgtagttggtgtggcaacacaaagtcatgctcagatgagaaaagaaccttcataaggattaggccaaaagaaatagtatcaaagtggcatatatataactagttattgaagacatgagaataaataatctcatctggtacataaacgatcaagctaataataaagaatcaagtcaaccctcagtcatttgtatatgacttacttccttcaaacaaacaaacaaaaaagcctttccccaaccataactgtgatgccttatctttcttagctatgggaaaaagtattaatggtactaatatataagatacttcaacagtaaaatgtgtggccaaagaatcagccaaatgtaaatagcttgtgcttctttggctcactgattttggtattagaagctctagcacattcagattaattcgagttgtatctacgtaacagtggctgtcattcattgactgcctaagagaacaggaagaaaagtgtagttacaactctaggttataattaaacatgggaagttctagcagtacaacttcagaatttggaatgagtgtgataaattaggtggtaaaactgcttttgttttattttaaaataagctttagcttattctgaggacataaaatccattttgactcaatgttggatggcaaaaactcatggcattttaggggcaggtttggggaagtggtttggtggattggttgacttcacttaaatgtgtgtttttaatacccaataattatttttagtcagcttttcacatctaaaccaggtaactggcttgataaacaaaaataattcaaatgagaaggactttttcctaaatttctgatatttttcaacttaagtgggtatggagaggagaatattagcgtatcatcttaatgatatctaaccagaaacaatgagctttagcctgtcattacggacagaagaaaattcttataacttggaggtaaacaggcctttccggagcttggagcaatgcattcagaaaaaagtttgtcctgtgtattagagagttcctagtttccaggaaagattgtagctgcctccccaaatagaagcctttttgcctccttttcccgcaagattagtccttaaaaccattatgtataaatttaaaaataaataaaacttgtatttaaaaaaactctgccccgaggaatgagatgttcagtcttcttttaatcagtcaccttaatgtcttttttccccttaattttcgttcttctgtctaaacaataactgaatgaaacaatcatgtatctccagtttaattgttgttgtcattctgcctcaatgacttatataagttaaaactgacttactgaagcaatactttttggttacattgccttccacttaataaaatatttcctctgttacttttagagctgcaaggtattttttcctactcagtacaacaatagcgtgggttagtgaacagattatcttgacaggcttggtggccaaagcattatacagccattattatatcttttaatattttttagctattgactaacatcaacgtagagtcccagtatttctgtaattctgcctttcatttatccgtgtaaataggccaatcaatttcatttgaaaatctgagcaagaaaacactttgaattggtaccagtagaatggtagatcacaacctcagcagtatcaaaaggtctttagaagcaggaaaaaaggtctaattaattgttaagagcaaataaatgtttctattttcaaatacactcctgagtccctaacccccaaagcaaaataagggggggaaaaaaccaaaacctttgattttattttccagagatgatgaacatttgttaatccagcattactgccaaagtttgaaccaggactcccccctgagccagcctcgtagtcctgcccagatcttgatttccttagagagtgaggaaagaggggagctagagagaatcctagcagatcttgaggaagaaaacaggtgagttttctttctagctttgtcattggtatgcagagtgcatacacttgcacacatagaaaagtgccaggaatcttcacttagagtcattttatgtctaattgttttctaaaataatctgtttagctccatttgcagattctctctctcttttttttttttgttatctgaaagaagacaatggatgcaatagtatgatgaagaactcatattttaggtgtgaaggagttaatgctgatggtggtatttgacttgttgcatgtgtctccaaggctttgattttatatttcagaatagaatttaagaaaaaagtaggttatttaattttatgattatatgattttttttacatgtgtttggccatattatctacctcaaacatttaagaaagtagggttattggcttggtcatattgggaaaccaattgtttcatcttatttttcatcatcaaatgcagaaattattatttatgctcaccatcatagcaggttagtgagacaattccaattgtcagccatcacctgtaaaagacagtcatgtaaaaatagcagaaattgtagaagagaaaaaggctaaagaactctcataatgactgcagggaggacaaagatgtaaacatctggggtactgtattgtgtcaggataatgcaaatcattggactttcagttctgtattacatttattatgtcacaggtcccttggtttaaaaagtcttctcacatgatcacttctaactcacaatgtgccttcttcagacagatgccaccaagcaaggatttaaagtagatgttgctcagatttgtgggtcttaagtactttcatctctttggttgagcccaaggcaccaaaagctcttaacgtaggcaacgcagtgtgtctgagatcagtgccctcgggagtatgccacttcaggatgaaaaaacaaactgccactcttccattgcttcctgctgccactgcgagccttctagctcttaacaccttttacctatggccatagctccttatctggttggcttccctttagtctctttcccacccttgcaataaatcctccatactgactctacttgtacatcttgccagaaccaagacccatcatggcattcccctttcactggatttctgcatgtagaaaaaaatcaagcttcttagtggggcgttcaaacccttccacaatattctcttgacttgctttttctatgccatcttcttttgttctccctgtgttctggctatgctgttgtagctagtatttctgaatacatcctgctctcatctacctttggggtcaagctcaagcttgagtctcagcctaactgctaacctctaacccaccactgccgtatctgacaaaggaatcccacctatcctccatcacactgctcaaaataactttccccatggagccctgctagatccctgcagttggaagaaatctgtcttttgcctctattcccagagcactttggacctttctcagaaaattccttgacagttttcctttttatcagttattaccagtgcctctctttaatgagctagtgtgtgtctttggggcatggactgtatcttaatcatcttcatatcctccagagtacttagcatggtttgaatatttaatggctactcaggaaatgtttgctaaaaacctgaaaatacagcaagaacatcacatgagtaccatccacgagataatattgaactttttttgttgttttaatgatagctttatttttggccgtacttttgagatcatttgtcagtgaagaccatggtagagaaaacatttctactttattgagaataatcagtaatatccatttatgttaaatctgtaattattgtaggggtcaaagtcaaatcggaataaaaagttggaactgacactgtaaatagaatttgatgttaccaaggagtaaatatatttttgaagtatatgatcgtgtaatatatcttttgagctcattggtcaagagccctgcctcgtttgtggttagcatagtctttctccgtaccattgcacccgggtcaaagaatgtttgtaaagagtactgataactatcatttatttatcattttatcattttgagtgcacttttacatattttagatcatttaatcttcttacaaacgctatggagaagagactgtcgcctttctgtgaatgagacacaggttcttagaggttcacacagcttgccccagatttcccagtcagccagtggtagaactgaattgaaatccagatttttctgactctaaataggcaactctgccttcaaccagataataaagaagagtaagtctctgtgaatgtcatttacatagaattgcggcatattccccagaatgtgccttaacttgagggactatctatgaggactgagtgtcccggaataaacctgttcatctacttgtggcacagcgataaccgctttaccctggaagatatccaagaccattctccaagaatgggatggtttgttctctaaaagaacaaaaaacataacaccaggcctacttagagctccaaaatgaggactctggggttgatgcaaatctttgtgtaagttaccttgaccttcacgaaatgatcaggatgagcttccttcattgtcccttcattttgtcctatttgaccttctaccaaattccaaagaaatgtctccacagagttcccttcctgaaaacagcccgtgtgttttctttgatctgccctgtcctgtcttcttgcagttctgcgcaaggagcttcagagccctagatttgccttcgctacccttgaattcagtgttgcttaaggagcctttaatttgccatttcctgttgagaaaacccaggaattctttagatgccctctctgtgcatgtctagctggctatgtcctaagtcagcattgggctacgcaatctgacaaatacgagcatacttttagagaaaataagaaagtatatttaaaattgagattgccccaagtcctttggatgtgtacttattgatctgttaatatatatattttatgttcctttagctgtgatttatctccaaataacagcaaaagagagaggcctggagagccccattcctgactagatatttattaaattccattaattgttcttattcatgacacctccctacaaccccctagaaaaacagaggatggctgtttgagaagtgtctcagaggtatcttatctctgcctttagaattccatttctcctggttgttgcacatagtattcaataaatatttgttgaatgcattaatgaataaatgaattgaagctgaatttattttaattgtagcatacatgcatgcacttttgactaaagttcttttacaaacctaatttcgtagagaaaagcctttcaaagactttgttttctgcttgcttttcaaaattctcccctttttcaaactgccttgattagcaccaggcatggctttgtcataaatttagaatgttaagaacccgttttccaaatcacaggcactgtatgtatcccacattggtgttctctgattcttggttgatgccacagagataaggctaaagctctgagtaaaagctaaatctgactgagtttttcccatagtgcctcccataagtttggatgactaatggtgttagtgagatatctaatctttaatatttcgcttctgcatcatatttctccctcattaccacatataattcagatacatctttatttggcaaagagccactggatcttgggtttttgccccattgtgtgtccttagcattgcagactcaaggtttacttttttttcttgcgttgattaaagccttcagtctcctgacttaagcctgtagtgttcaaatacagagatgtatttgtctctgcactgtctaaataaaccaagacttgctctgaaattcaaggtatgatcctagcaatgaaaaggtagcctttctgagagacaaagacattgtcgttctactacctgcagagcaaattgattagattgttctcaagtcaacaaggtggctaaatattaacctaattcaccataaagtctaaagttaaagttgttagtagatgttatataacacgagggaactctgtagattcttaatacctactcaggacctttcatatgtcttgttgggcagtaagaccttatgaagccaaaatttgagttttctctttttcctttaaattcctccagtgattgtgcaagattattattgttacagtcaaagaagttctagatcagttactgataccactgaattaaagtagctggaaatcatgatcccgttgctttactttgtaattgacttgatgactttggacctagtctagtagctatcaatcttcatagctacgggaaatctttattcaatgttctttcattaggtctttgtgcaagtctccaatgatggtgaaaagatggccaaaatgaagggaatctgaagaggttaggaatgggcattcctatggaatataaacaaaggtgtcagggtgaggaatggcagagtttgtttgagggaaactgcagttgtattaccttttttaagaaggcaaagaatgagaggagatgaggctgaccaggtcagcaagggcaggtcgggaagggtgtggtacccactgcagagttgctgcctccgtgcctagtctagggagcaactcaagggtgtgatccaggagtcaggccatgatattgacatgaatatacgccacacaggcagctgtgcggagggtaactttgaaaagagcgatgctggaacgaggaaatcaagctggggggagtcacatgggagcccaggaaagagatgattagagccttaagtaaggtgatagaaatgaagtagacaggctgatctgagtgatatttcgggggaggatagagctgtttgattcggtagttctgtgggactagggtatgaaggaatgattcccagggctggtaactacaaaacaagatgatagtagttatttgcagctgggactgataattcaggaggagttgcagcaggtccatcctttaatgcagcagtgtttattagaggtccttcctgaagggctgagtagctggaaggtgataaatgaggtatggaagaggtcgagttgaggtcctggtgacatctccatgtgtaaatgtctgacagtctgagagatagaactctgatgcttgtagaaaggatataagcctgagatattaggactgtgagtcgccagctcacaggtggtagttgaaaccgtgagaatgaatttatatatcccgggagcatgtagcagaaggagaacactggatttggtagaactccggaagatgtgaacattaaagtgtgtatttaattacttttatttttagtagagaatacatgtatattattatacaaaatccaaagggttcaaaaagacatatagagaaaagtgaatccttctccaaccttctcccctggctgtggtgtttccagctctggaggctgccatctttcttggtttcttgtgtttccttccaaacatgctctctacatatgcaaatatttgcaaacatatttatggttgttggggttacttcacacagtgtcgtgcagtgttcactctggttttctctttttacttaaaaatctctaattttcacatgctggagaaatgtgccagaagaagaggagggcagagcttgggaatgatgggagcattttcccacaggaggcaggagagagaagggttagggaactaaagtatgggaggaggcgtgaccttgaatgagaggaaggactgcctctgaagacaaagtggtaggtaaggaatttagggtaaggaagggaggaaagaagcataatggaatgaatgttaaaatgtccagtagacatcactggaaataattcaagactgattcctacggctgttcccacatgtttttaaagttggagtggagaggaaagcgtggtatatgatacatttaacgaaactaggcattcaagttacttggtgtattagtccattttcatacggggcaatttacaaagaaaaagaggtttaatggactcacagttccgtgtggctgggaaggcctcacaatcatggcagaaggtgaaggaggaggaaaggcatgtcttacacggtggcaggcaagagagcatgtgcaggagaactgccctttttaaaaccatcagatctcatgagagttactatcacaaaaacagcatgggaaaaccccacccccatgattcagttacctcccactgggttcctcccatgatatgtgcggattatgagagctataattcaagatcagatttgggtggagatccagccaaactatatcatttggtgacatgggccccaaaacaaagggctacagagcccttcttgagacaaagggagctagtttgatcacagaaatcagaaagccaagaccttttatggcaaggatgaataagagctgaagggcatacatgccacatttaagaagctgtgtaagaatggggtcaaccatctcagctctactcaggcagggaggacaggaacatggtagaagtggaatcaccattattcacagactcagtttctaactagcagggccagtgtaactaaatttccttcagtttatccaaagttaattgaagtctgaggggactgattcatagtatgcagttcatggcagtgaatggataacccagaatgaaagtttatttctccctttatcctaattatctctctttttaactgccttgtattaaaatgttatcaaggttgccttaaagcttttttaggaggagacagcatctggtttaagtgcaaatactagatctattaaaatgaggaatatattcattttttcggcacacagcatcctgtgtcttagaatccagtgtcttaggaatcacaataaaaatcaaattgtgttctggtgagcctagaatcttggcatctaaaattggatgtttgtgaggactgcttcatactacaaaaaaattgaagcacccctctggcgattagaatattcacatcttacaagtacagctgccatctccctagaacatgctggataagagtttatgttcttacaatccaatttcccttttttttttttttttttttttagatttttcatgaagaccctcatcctcctgttggccttcatttgccaattgtccctctacagtagaattgattatggtcatgagtttctttagctactttccaggcctgaggatgtaattctgttcaattctgcagatagttactgagtgcttaatgtaattttaaaattatgagactacaaagatgaataagccttggttcttaccctcatggagctcaaaatttattttaaaaaagttaaaatagaaacaactacttatatcctactgttacaagtgctctgggggcacagaggtgaatgatttattctatcagagggagtagagaggcctttacaaagagagtttaagagttgaagactgaatgggagttttccagtctgagagatgggggaaggatgagttttccagactggtggaccagtgagtaatgtgtggcttggaatgaggagaataagagggcagtgggatggtaggtggggactactgtttaaaggactttgtgcatcatactaaggagtttgggttttatcctataagcaggtgaacagtgatggctttttgacgggggggaggattgagaaaaataactgacctggcagaaagctaaagccatgaagattggtagaagcacagtggaatagtccattaaaagatgccaggttcttaactaaggatgtcttaggcaagtgaagaaggggatggagaaattagaaggtcactgaatgaatgagaccaagggaaaatggagagggggaggcatctggtgttacggaaagttttaatttgggaactgggaaatgatcattgaaaaacaaacaaaagcaacctagtgcacccaggaaaaactcctgatttgcaaagggttagtgcatggagagaaagagctacgtatcagacatactgaattctatttgcccaaggacatttcaagtggaaatttcctatgttgattttacgtattcagttttcagaaaggattctttaaaaagtcatagcaatacaattcctgcaatataaataatagatcaatgaacatcatagggattagcatagttgatttgactaagcttcagattcagtttgagcttccctgtagccagggagataataggaaacaaagatttgtctgtctcttaatattgaattaaagaagcacgcagcatcctaaagaaacatcattgttttcctggctctacgtaataataataataacaaaaatagctgtcctttgagtgattgctatggacaggaactgttctgagtacatatgaactcctatttaatccttaaaacaaccctatgaaagagaggctgtttccagaggattacgtggcacagagtattaaggacacttcatatggccagcaagtaataggacctgtattcaaacttgggtggtggtcctgaactcttaagcagcgttacacttgaagtgattattggctagtgtccttatcaacatttttataacaaatcccaagggaaattatatgtggctgtttctcatggcctttgataattgtggaaagcttaacattaaaacaccaaagatagggtgacagttctccaaggataaaggtcactgttgcctaaaatgtattctgcagaataccactgagatactctgagaaaaaaaggattccaaggacagtaaaactttgaaagcactcatactggaaagtcatcattacgttagcatttgcactgaggagtttggaagtgaagaaacctgattagctttgtctaacctcatgttgctcccacttacttgacctcgagcccaactgcaatgttatatggaacacactttggtaaagaaattcaagtctgaagtaaactttgaaaaccagtctaggagatagcatagttgactctctactgtagttgttgagaagcctatccgttgtgtctctgggaacatcagaagataaagctataacaggtgcccacgtaggaagcctggatttttcgcacaaaagtaacttttcatatgctctagtggtgaagcagttaccctgtagacccagaagccagaatgatttagtctgaaaaatctaaagataggtattaaattaactctcatgatcatagaaaattctttgcaccatttttgtagaatatcccaccgaataacttggcttttcacccaaaccaccaagaaaaattgccaccagtgacttgatgcaattaacttgctatcgggagttctttcttgtgaaatgattgaactttgaaagatgtttaccaaagacagcacctttagcttcatcacaattactgtggaatctttctttgtaagtagttagatgcaaaggccagttgttgcttgaggcctctcctggattgtgattttaaagtgtatcatcaacacatgggaagatatttctccctctttatcttatgacagaaatgcaggtatagctttcatctcaaagtaagattaaggtataagttacaaagatgtgtagctactatatggtcctgtgtaatgctacttgaggaaggctgttcctttcctggcactgaaattttagagcttgcataatcagtatatcaacctcgtgtggcttggtgcttagcaagtttcagcttctagagcccatggctaatggagccatccaggagaatgttggagagataggtctgaagccttagaagagaagtcttgattaaggagtaatgagttgcgggaaggggtcatggttgtggcggagatggaagcctggggagaggacagagacctcctaggaagagagtttgtgtaagaagaagaccaaggacctcctgatgtacttgattgtaattgggcatgagcagcccagttagaaatggtttcctgttggtattacatatgtacatggatggcttctgcagatggctaaactcacccattttatttttttactatcttaatagttaaaatatgaccttttcttgtgtctccaaattctgagttaccttatggtgctagtctgtctgttgtaactacaagtcataagtaaatccatatgattcttttcctgtaatttcctggtaaatcaaggcgataatttcaaagataaaaatctgtatttttagctttagcagtgagcatgattcccagtctttttgccttcgagtaaggtttgtttccatggtggaagtaaacaatatcccacactctagaatgtgagctcttcaagggtaagggacagtgtcctacatatatctttatctccacagcactgggtacataaatgtgtcataaaaatgaatgggtaaatatcctttggagtttttctgttacttgatgggtttttggggttgattttcaggtatctcccttgtttttctcatttcttacattattttctttcccaaaatcccttaatatacctgtttagtttgtgatgtcattttccattagactgaaaccatccaagttgtttaggctaacccagacttaagcattttctgggcttatttttggactctttttaaaactcatcatctgaaaatatttaatgtccacacggataattctgaagacatgtgcataccatttttcttttatgtacatgggttaaaccttgatttttccatagtaggagaaagcattataagattttattgttttcactggggtaatatcttttgtgctataagaaataaaattttgaatctagaacttagttttttataagacctttattgagatataattctcgtaccataggagttacccatttacagtgtattagtcactgattattagttaataggttaaccagtattagtaatcactggttattaattacagagttgtgcaaccatcagcgcacaattttagaacatttttatcaccccccaaaagaaatcccatccccattttcaagtcactcctcgtttctcctgcaactactcttttcagccctagcagtagacaatccctgatctactttctgtctctatggatttgcttattctggactgttaatgtaaatgaaataatacaatataaagtcttttgtgactggcttctttcacatagcgtaatcttttaaaatggtatctatattatagcccgtattagtatttcattctttctttaatgctgagtaacatttcattgtatggatataccacattttttaatctattcattacttgatggacatttgggctatttctacttattgtctgttatggataatgcagctatgaacattcatgtacaagtaccggtaattattttaaagaagttattctgggctgggcatggtggctcacacctgtaaacccaacactttggcaggctgaggtgggaggatcacttgagaccaagaatttgagaccagcctgggcaacatggggagataccgtctctacaatttttttttttaattagccaggcatggtggctcatgcctgtagtcccaactactcaagaggctggggctggaggatcacttgagcccaggaattcaaggttacagtgagctatgattacaccactgcactccagcctgggtgacagagcaaggccctgtctcaaaaaaagaaaaaaaaaaaaaagattctatagtttctgtcattgtaatagaggaggccataggatcatatatggcaagagtatatagcagtgcatgccagggagtgaaaaataggccatcaaattgaagttactgggagaacttaagactaagtctaactacgcatgagggattgaagccgggacacacaaagcttaaaattatgattcttctagagactgttacggctttttgctgaccacagacaatgaaagtttgatattttgctgtatttgtctgaaaatggaaacacacttttcccaatggcagtattcctgaggactagagttcttcacctctaaaacctctccaatcctagtttttccttttggctgatgatgaccagccactgccatttttgtcttaggttttgttagtctgtcttatttccagttataagtggttaaaatttcttatgaattcttcttgtgttgaacttttgattaatacatttagtctatagacagtaatgaattagcatctgatcaggaatttgtgaaaaacatctcagtcattaaagattaagaaactgaagccaattaatattgtcatgttctgtctcttggaacttgagcaagatacagatctacgtgtcaatgacatatccagaaaatagactccacctagatacattaaccctgtacccttggtccacatattttatttcagcaatgatccatggacatattataatttgacagtttcatcacatacctagcgtattgggtcaaatcaaggaaatctcatcctagtgatcttaactcagtgatttcattttgcccagatgttcagctgtgataaactttactaaggcacagatgatggatgatacacaataattccaaaatttgggggtggctacaatgtggctaggggctagaactcaggtatctacaggacaaatactgagtgattagtcactttctaagcgctagatatgcatatgttctgccaagctcagtaggtctaagtagattgcttccatttcagataattaagtgctttctttttataggaagtttttagcacatctgaggttctaaatccaaaaagtaaataatatatagagaaagaagtaataacaataataatagtaaccaacatttattgaacacagtatgggctgggcatggttcaaagaaagtttgacatatagaatgtcgaccatactggcttaataatcctcataactgaattagtgcttaagtcagttgcccagcctcagcaagcagcagaggcaagtaagtcataaatcaagatcttctgaatccaagaccatctctcaagccttgttctaattctctcctcagccatggatggtgaaaggcaccacaaaggcagcgtgtcaaaaagtggcattgttcaacctttcccctgatggggcaaagcttttatttttttcctttacgttctttgacatctgttttaaaatgcagatatcactagaagaaatgacaactttattataaaatcccagtaaaatgtaaatgtcttatataaaacctttatactgagcaaatttcagtaggaaagggcttggaagtaaggctctgaatgttttaaagggggacagtgctaagaaatgattagaaacaagagcctggaggggtcctgccatttttactgttttgcttaaggctgacctaaaatatgcatagtcttacttctcaccctgtgagcttatccttattaatgtctttttccacctagtttaggggtatttttgaatttgtgtttgataaagatgtctaaagctgtactgtaaaattttattgtcacttttttttttaaatggagtctccctctgttacccagcttggagtgcagtggcatgatcatggctcactgcagcctcaacctcccagactcaagcggtcctcccaccccagcctcctcctcctgagtagctgagactacaggcatgtgtcacgacatatggctaatttttttcaatttttttgtaaagatggtgggggtgtctccctatgttgcccaggctggtcttgaactcctgagctcaagtgatcctcccacctcaacctcccaaagtgctgggattacaggtgtgagccattgcactgagctttattgtaatttcaagggctcaatgcaatttccagtttttaaagttcatcttgcttgcagaatttgtctttcatttaaaaaaaaactgctgattggctacatttatagctgctgtaatagttctgtatgatttactacatttgcctgaatttagattggtggatatgatttagctgcttttaatattatatgagggtaaagccagatttctttggatctattccttttagatggcaatctttgtagttgttctactttacaaaataatccctgtgtgtgctcatgctttggtatacagttaaatgtatgatactgttaagaaaacattgatcactggaaagtgaccttcatttctttatttcataaatatcattatacaactatataactacacgtagtagggaagctccatttaaagagtagatgacttacactgaaatcatttgacctttgtaaattagtttaaattacacagagattgttgtaatgttctttatcatacataatagttacgattgctagagaggcactcataaatcattgctaaaagggccagctgctttcatgttttcagcaggttgagttaagggaacaagccttgccaatttgattaatctcttatgtccattagttggttgggaagtttttttgagtgtaaatttgtatgtagacaacagagtttatattctttatgacataaaattaatcagatatatctacatatttgtagaatggggggattcttagctctatagagaataagaaatactggatggaagactttttttaggatgactggctacaggaagaaattgtagtgacagaagccatgtgtattgaatttgaattaatgttccttagggagctaccagagaaatataatttacaagataatcaagaacgtaaatagattctctgtggagtcgttgtctgatcactgacatatattcatctgtattgaaatgacttcatgactacattctaacaattagagaatcattaggggtgagatgtacgtgtataccttcaagaaaagcaaaatatgtattggtaataattgacagctgttaaaacgagtgcattgtgtacttgttaaacattagaggctgggcatgttggctcacacctgtaatcccagcactttgggaggccgaggcaggcggatcacgaggtcaggagatggagaccatcctggctaacacggtgaaaccctgtctctactaaaaatacaaaaaaaaaaagccgggcgtggtggcgggcacctgtagtcccagtgactctggaggctgaggcaggagaatgtgaacccaggaggcagagcttgcagtgagctgagatcgcaccactgcactccagcatgggcgacagagcgagattccgtctcaaaaaataaaaaataaaaaaataaaaaaaaaacattagaataacttaccttggaacagtaactctgagggaaccttgatcatttatgagaatgatctcccctacgttaatactgcatcaaaactaacattatggtatacctcaaaaagtattggcatagatgtttttaaatataagaaaattcaaatgcgtaattgataagggctaaatggctcaatttcccaacccctaacaaaaatatgccctaacacagctctgtgactatgactgcatttattagaaaacatttagtaaaaatcatctctagttcaaaccctccagcatcagttcttcttgataattctcatgaacatttagaaataccttaaaagagaattcagactcaaatcaaaaaaccttatttcatttggttgcaggccaagatacctcttttaaccatttctggcttttagaatccttatcatgacagcttgtcctatctcagagcttcaggaggaaaaactagtccctcaaaatcaagtttgctattgagcttaataagaggtttctgtatgtcatatgtttgtttagaagaaaagcacttgttcgactcatttaatcctggcctgatgaattaaggcttgaattaatactgagggaaccttgactatacatctacaaaatcaatgtgtcctggtaggcttctgattaagataacattagctcttgcttgaaggcatctttctctgctcctaccatttatccagtggtagataatatatggagtgaaaaatgaaaaagacatagctgggctttaaagcaagatgaacatctctgtgaaccagaaatgtgaaagaaaaaaaaaaaagtaagtggggctaaattagtgggctttcagctcgtgctgtagtaacagggattaaaattctccttacaaggtagtggcccaaagccaggattactatttgaaatcagagccccacaaaaacacacctagagagagacacatacacacttacacttaaaagcaacatgaaaagaaacagtttgctgcaagggtctacagcttatatgcagctatggccctaatgcatagagccgagggaagaggcaaagattcgcagttgggaaagagagcatcacagccttgaaaccaggacctgaaccaatctacctactgcctggcaatgaaatgagtgatatctctgtatcactcagtgtaggagctgcaaactaccaacagatgtggctctaaactctaagcccctgggtatggctgggagaagccataaaaccacctgagagagagataatgagtttaaaaagagaggaaaatattaaagtacacacacatgagaataatagaaaacatacacatgcatatgtatgcacatgcaaaacatcccttgcaaaatttgtctccaaatcacgatccaaaatacatgaagaaatgggatagcaccccccacccaagttaaacatcaaaaagtgaattaggctgggaacagtggctcacacctgtaatcctatcactttgggaggccaaggtgggaggactgcttgtgcccaggtgtttgagactagccagggcaatgtagtgaggtgccatctttacaaaaaataatttaaaatatattagccaggagtggtggtacatgcctgtagtcccaactactcaggaggctgagataggaggatcgcttgagcccaggaggatgaggctgcattgagccataattgtgccactgcactccatcctgggcaacagagtgagaccctatctcaaaaaaaaaaaaagatgaattaattctagaagaaagcaaaataatacactagtacaacaaagatttttacttacatttaagatgctcagaccaggtgcagtggctcacgcctgtaatcccagcactctgggaggctgagatgggtggatcacctgaggtcaggagttcaagaacagcctgcccaacatggtgaaaccctgcctctactaaaaatacaaaaattagctgggcatggtggcaggcacctgtaatcccagctactcaggaggctgaggcaggagagtcgcttgaacccaggaggtggtggttgcagtgagcggagatcgtgccactgcaccccagcctccatctcaaaaaaaaaaaaaaagatgcttaaaggcataaataaggggtaccactcgctaaaataacaagaaactaagaaacagagatggatgaaatgtaactaggtctgaaaacaaagatatctttgccaaaaaaactagtcattgaagttactaaactcaatatacaggataaattctagactttgtcctgtcagagaaggcaagggaattagaagatgatgctgagaatgttactgtgtacaacactcacagaaaaagataagaaatataaatgagcaattaggagaaatggagaattgaccacaggctctacaatataccttactagaatttagaggtttgtttaggagtgtatttgagaggtttcagaagaaaatggaggaaatggtagagaagtaatatttgaagctgtcatagctgagaatcttccagaattgaagaaggatgtgagtcttgaaggaaatgtgctcccaagagaaatttcaaacatctgggaaggaaagaaaggcctgcattgagcaattgatattctttacagctcagctttggctgattaaaatgagccttttctgttttcactggaaaccaccaaaacagaaatgtaatgtgttgtatataccaaaccatgcctcttgaacaagggtccttataaataaatcataaaagaagagccctgtggacaactaaacccacaggatcaagataccaaggaagatctctctagaaaaggcagtctcctgtcagcacctttgtgaaaaataggtgggaagacagtaatggcttgttgtaccatcttgaggtccatgtctaaaaactgttttcaaaaggaacaccatggctgccccaatctggtagaaagaaaaatttgaataggattctacataaaaagtgttgccagttagaacattttgttgaagttttcttttaatgaagagggaaaaatagaaagtaattcctatggaatgagaccttgtgaacattggatactgcttcaagttcacagaaacattgaactgattgccagttaagttctcagaaattagatttaattaatgtggacagttacatacatcggtgcacacccagaagacccgtgtgcagaatctgactgaaggtgtacttacttcgatgaatctcttctcatcactgctttgtcaaagcagattgctatgaaataaactatacaaacaactacccttgaaggctgatagcaataggatttcaatcagtacagataggagattctatttctgtagatgaaaaagatcatacattgattttctgtgtgactttaaataaattcctggaaaccttgtaatgttaggtactaggtagaatgaaaaaaatgaagcaaaacaaaacaaagaaaaaaaccagagtagattgggttttctttctgcttccatgtggagatctagccttttgaaactgagcattttggaagacatgccgtcccctgtggaatgttcattccgagtatgggacaacagaaaatatttagcagacctggtgatgagatgatcttgctttctcaaactggacaatgggaaaactcttcttggctactcactacttacatttcatctcttttctcattgatatagatctcccacatttgtggataggaatttctctcacctgatgaaatatcatctgtgaacaacagaaatctgtcatcttattttggtatttatcacaagtagaagaaagatgtcaagagttctaatcagtcactggatatcaaatatcagaaatgtcctcaattggaattgtattctcagtaaatcctaaagcatttgggaccttcacatgtgctaatactgtttatatttatttggaaattaaccaaatataaccaaaagacagtggaataaccatagaaacctttaaatggaataaaatttatggcaatcaacattattaggaagaaaaagtatactacctagaaacagtgcaagaacaacgaggatcttctgtgcatctaactatataggtctagaaatatataaagtgaattatgatagaattaaaaggagaaactaacaaatccataattatatctcaacactcatctaacaaaaattgatagctacaaataatcaaaaattaataaagatatggacaattttaacaacaaaatcagcacactatgtatttagagactccatctttccaatggaaaaatacacattatttcaagtactcaatgaacatttttagaaagtgactgtgaactaggtcacaaaaagaagtattgctaaatttcaaaggatcagtatcatacaggggttctctgattgaaacgcaattaaattagaaatgcactaagaagtgaaaatggaaatataaccactgtgctcctaaatgactatgggttaagttaaaagaaatcacagtaagaattacaaaacataaggcactgaattgaatcaggtgatgtatataaaaacttttggtatataattaaagtggtaccaaggaggaaatgtataaccctaaatgtgttcattaaaaataaaaaatcaatgacttattcaacctgtaaagcaagaggaaaaaaaagagtaacaagtaaaacattattaatggacataaaatgagaccatagtaagtaaggagcttcactgcattcttggatgtgaagactcaattattatgaacttagttcttcccagtttaacctatgaattcaatgtaattcaaactcaaaatttcaacaagcattttcataaaatcagaaaaccaaacactaaaatcatggagaagatcaaaggggtcagaatagtcaagacaattttgaggaaaaacaaagtgggctgagaaggcctatcagacatcaattgatttaaagctggagtgtgggatctaccagggatatgcagatagaaccacagactagaatacagagctcagaagcacacctgtatatttatggacacttgatgttttgcggaagcatcgttagagatcagtgggaaatagatggaccatacaatgaatgaggctggcttcatagtttatccatgggggaaaagtaaaattagatcgcatgttcacggcaagcacaaaaatagattctgggtaaattcaagtcctaaatgtgaaaaaccaaattttaaactttaaaatgtaggtgtaagaaaagattttcgtgaacaaaacataaaaagcagagaacatacagggatatgttaaaatttacatcttttataccataggatgccataagcaaagttaaagataagctacactaagataagggtagaagatcatatttgccatgcacataactaacaatggattagcatctagaacatatccaaaggtttaaaaagaaaaagacaatccagcaggaaaatgggtaaaggaagcatgaaaagccagttaacatggaagaagtctaaccttgccagtaatccgggatgtatgtgcaaattaaaatgcacccatcaggttaactaaaacttgaatgtctgataacaccaagtatttggtgaggaggtgggccaaatggaaaacctcattcactactgaagcgagagtaaattggtaaaagcaccgatttgtcacccagagcgattcggtgacatgtagcaatgttgaagatgttgctaagatccaacaattccacatcaaactatattctgtaaagaatctcttcaacaggtatccaaggagataggtataaaaaagaatttcattgtatcattgtttataatagtgaaaagttggaaacaacctaaatgtccatggacaggaaaatgttggcatattcaagcaacagaataataataccttatggcagttaaaatagcaaactattatgtatcgacctggagaaatctccaaaatggtgttgaaggcaaaaagcaactcttagaatggtatgtatattcttaaatgtgaagttcttaaatttaaagtttaaaaacatgcaaaataatgttattagattgaatcacataaaatgggtgtttttgtaggtgaaagaaaaatacaggcaaacatcagcatcttttttaagctcaacctagtatttgttgatacattcatggtaacactgggcatgaaattcagtgtggcattatctccttgagggcagcggggaggagagaatggtatggtgttgaggcgggcatgtgagggagcttctgctttggctgttaacttttctttcttcaaaaaacttttgaagaaaatatggcaaatgataaacttatcaaggggaggtgataggaacatgggtatacttactccattcttatacatttctgttgaaaatatttgctaatgtttagagcaaaccaaagtgttgatagaggtataaaatttttaatctcatgacattataaagaaatatttacaaagtgattaaatcctttgctgcttacttatctgaacataccagtcgcgaggcttttagtgtaacataaaaaattgaaaagcatggctcccttcacacaccaggcaaaagcttcaaattttgttttgttcttttagcactggtaagattgtcatcattaaaaccattcattagtgcctcttttgcttgctgttcttcggtggcagtcagatgcatctatctaccatggtatataaaatttggtgatgatattcaaattactttttttcttctttttctttttctttctttttttttcttttttacttttttgatgccaataggaatctgcaagcagaatatgaccgtctaaagcagcagcacgaacataaaggcctgtccccactgccgtcccctcctgaaatgatgcccacctctccccagagtccccgggatgctgagctcattgctgaggccaagctactgcgtcaacacaaaggccgcctggaagccaggatgcaaatcctggaagaccacaataaacagctggagtcacagttacacaggctaaggcagctgctggagcaagtgaggagagagatgggatttttacaaacattcatttttccctcttaaacaaaactaaacctcagagagcactttttataggtgcaacaagcatcaattcttaagtgcttggtatgtgcctgcaaagtgatagtatcaaaggatagaagtagaggagatagaaaaactagtgtgtcttttttgtatttgtccaatattgtttcctaccaaaatggttttttcttgaccaatttgaaatacatcttggggaaaaaaacgcctaaaggtttccactagttctctaaaagtgaatatttcacttcttgaaatggaactatttcatttacaattagttatattttctggtatacctttgtgttttttttctcctaatccctaacacatagttctttaagcctccatcgaaaacctagcaagatactgcattgtaagaggacctacctggacatagttctggctttctgggaattttaaatttttcaattatgttctctctatcttgttacttaatacttcacaaagatatgaatcttccattacagttttgagatctcacatagtctcatcattcacacatgaccttctaaatcttccagttatttaatgtaatgatgtatagtctcattccagtgtagctctgatttttttctcaaatttataagggagcacaattcagatacaaagacagtttctatggattatatcaacagtgaaatatcccaaattaaacaatctttgggagggcttctaaagtaggaagggtcaaaatttatgagtcctgagtgtgtatcatattttgaaatttatacatttgtatgtttattatgaaaagtaattctgttttcttttggatgacttagccccaggcagaggccaaagtgaatggcacaacggtgtcctctccttctacctctctacagaggtccgacagcagtcagcctatgctgctccgagtggttggcagtcaaacttcggactccatgggtaagtgtcctagctactctcagattttgttgtctgaagaaaggtagagtcgtattacagggacatgaatatttggccgtaagtgtttgactcatcttggtatcagggagccactgaaaatcatataccaggcgaaaaaagtctaaaaagaaaattctaaaaaggtgtattctggcagctctatctggcccacagaaaacttgtataggtgagaagaccagttaggaggcaattgccaaggccaagattggtgagttctgagggcctgcacttgagagatgtgggaggagaggactgtgagactattctataaaaatagacttgccagggggctgggcgtggaggctcacgcctgtaatcccagcactttgggagggtgaggtgggcggatcacaaggttaggagttgaagaccagcccggccaatatggtgaaaccctgtctctactaaaaatagaaaaattagccaggcatggtggtgggcgcctatagtcccagctactcgggaggatgaggcaggagaatcgcttgagcccaggaggcggaggttgcagtgagccaagatggcaccattgcactccagcctgggcgacagagcaagactgtgtctcaaaaaaaaaaaaaaaaaatagagttcccagggtctggggactgagtgcaaattgtaagaagaggaatgaagggagaggatttggttggaagaagatagtgaaacttctgattgtggacataatgtgtttgagaaattgacaggtcttctaagtcatgtcccaaaagaaattaagatacagatctatacttgaagtaagtgggcaaactggagagatttgagaatgagtttcatagaattgattgctgaagggtgtgagatgagaaatctataaaatctataacacaggtgcttcgatccagtgccttggaaaagacctccatttgggtaatgggatagtaaaggatggataagtagggaggttcaaggaagatgtgacaaaaaggtgaaatgctaaagagagctcaatggaaattaaaataaatcacagtccattgggtcactataaatgcattgggtaattttgagaaaccattttaggccaagagaagggaaggtggaaaacttctgtttcaatgaaatgaaagactaggtaatcttaaaatgaatgaggattaaggaaagtgaagacaattttgaaacattaccaagtaagaaggaagccttaggcaaaagttggatgaatttgttgaggaaatggtccacatgttctgttctcattcttagcaatgttctctgcctaggactaggttctaagaaaggtggagctgatgaggcataaatgatcaaaggtcaaaacaagagtagggcattttacagtggtaatgaatggctaggacaggggttcctagccagctgctcattggtttttcctgctgtgtctggctagacaatagagggttttatgaaggccacaaatacttggtcccccttcctcatttctctttctctgtaaaggcccagtaggagtcagctccatcctctctccttacttttccctgggacctaaactggttatatacttggtcctctcaaatcttacctcacagaatagaaaagacctgtgactccttgattccatacacttacagctctattgcctgatatgatgatgtgttcaggaattcatttcatacttgagctcttccatgagggtagaataaagggaggcaaagtgccttaaccaaaatggataggacagaaaggaaaagtcaggggtgtgggtgagttttatggcgaaaaatttggagatcacagtcgggaaaattcaaaagttggatatcatggaagtaaaatactttcaagcaatttctacatctaacatggtgcctcccagcgagctgctgaagattttacttggagatcactgaggggtagggagtacagttcatggagttgatgagaccaacgttgctgagcttatcagcagaggggtgaggtccagatcctgacgacagtggtagatcaggatggaaaagatgttgaagaagatggacgagggctctgaggagatgaacatttctgaggaaagagacagggtagttgaaataaatgtgatgaagttcaagaacctggagcagtgggaagaggcacatcctcctctggagaagccaaatcttgtaggaaagccaggttttgatttttttgagaaggaaaaggatatgtttgaggttattttcctgaatttactacacctccatgatttaaggcaatctctgtgtcagattatctccctccacctgagatctgaatatagctaataaactgttgggattgtaaatgacaacacactacatgaaaaacaactgtatgcatttgcaaagtctgtaaattctgaaaacaactgagctttagtacctcttatttttttctacttcaggattttcccccttttttaagtaagtaaagcatatgaaactaagttacatattttagtggtcagattcagagccctgggtgcttagaagcattaataattatttaggtcgttgacaatggcgaataggcagcatactcgttaaagcactcaaattaaagtgcacattaggatgtggtcctgatgatctgtggagctaaaaagatcatggtagaactgaataccaggacaaaagtgctatattccaatggctaagctaagagataacttgctggcataaaatggataagctgtgttaaatttgtcctctgaaagaaaagactgaattcaagggtactttttcttgaactgtgtattaatctgttttcacactgctataaagaactacctgagactgggtaatttatgaagaaagaggtttattgactcagttccacaaggctggggaggcctcaggaaacttacaatcatgggggaaggtgaaggggaagcaaggcatgtgctacatagcggcaggagagagaaagcgaggggagaactgccacacttttaaaccatcagatcttatgcgaactcactatcatgagaacagcatgggggaaaccgccgccatgatccagtcacctcccaccggacccctcccgcagcacatggggattacaattcaacatgagatttggatggggacacagaaccaaaccatatcgaactgcataagctaacttcatttaaaaaggaaaaaagccttaccgtcttcttgaaggatgcacacaggtgtttaaataaatgcagtgtatatacttgggctttgaaggtttgagatacaaggctgggatctgctgaaccacattctggatagagctgcattctttaaatatgcaaccccgatgactgattttcttttaagtgaaacatgagacaagtcatattaggtgatgtgtctaaagagtcaacatatttcctcaagccatgaaatacttatcactgagtctctatgtaccatttgtattctgtacagttcttactgagacaatgtgctaatgaaacgtacattctattggaggaagcaaatacagaacaaaatagcaattaacaatgtttatcccctattggctctcatgggctccatatacaaatctgtgatgtccagacaactccttatctctgatgactcctaactttccaccagattactgttttttgaagcattttatattttattgatttaaaaattaaactgttcctttgctttttaaaaaatttatcatgtacatttgaggtttatgacataatggctccctagctttttatttagaacaatttcaaacttatggcaaaactgcaattaattcaacagtttgccacatttgctttatagctatttatttatgtacttttacattcatgtgttgttaaatggattgcatatatttagattaacatgtatatctgtatgttaacatatttttatatactgtatatgtttatattttatgtgcatatttaatcatattcatgcgtgtatatagtttgtggatttttttttcactgatccactcaatggttaggtttcatacataacacttcacccctaaacacttgaacacgtgccttctaaaatgaaagatattcttgcataagcacaattatcatgctcaaaaagaacaatactgttatataatgtagaatttaaattcaaatacctccaattctgccaattaatattcttcatagcgatattttacattcaggatcagtgatgtccctgtagtctcctttaatctgaagcactttcccagcctctttaaatctttcatgacattgatatattagaagaggtcgggctagatgttttgtagaatgtcccccaatttgaatttgtctgcttgtatccaagtgattgggttcgggttaaatgttttatgccagattaccatataggtaaggtatcctcagtacatcacatcaaggttttcctcaagattctccatccccttcaccgttcttcactctccctgggcgctccttccatactttggcttctgctatgctgacaactcttaagtcaagatttccagcccagacctcccacctgagcatcttctggataaaattataaataaaaatatagcctaatctgaaatcatgatcaacctttggagcatctcttccaatttcccaatctatacaaagtcattttctaccccttcttcctttacctgccttccttagctatgttccaccaccatcaatccagtcaccaaggtcagtgtgttttgctacttatgaaaaagagcaaaattcttcaattcagctacttctgcccaaatttagccctcatcatgtgttacctgaacagacaatatgaatactttcctaattggttcctctgcctttggtctctctccctttctaagctatcttccagaaacttcagttcctcttctaccattcaaattatatcatattattcccctctttaagcattttatgccttctgtttgacaacagaataaatgtgctctttggccttgagtacattatgttcttaacctgaaatatagcatcctttcttttcactcagtgagttttcttttggaacttaatcatgcattatatcattctggttttgttgttgttgttgttgttgttgttgttgttgtttcttttgtgtgagacggagtctcgctttattgcccaggctggagtgcagtggtgcgatctcagctcattgcaacctccacctcctgggttcaagcgattctcctgcctcaccctcctgagtagctgggattacaggctcgccaccatgcctggctactttttcttgtatttttagtagagacagggtttcaccatgttggccaggctgttcttgaactcccaacctcaagcaatccacccgcctcagcctcccaaagtgctgggattaaaggcatgagccaccacacccagccatgttttcagccagttactagtacttctttcttctgcctacaactccctagaacttaagctccttaaggacaggatgtaagtcttgctcattgtcgttactgtatgaggatactctgtgcaacaaacaatcagtaaagtgcttgttgagttaatattttagaaatcaagcataatacattcttgtgtacacatggaacagcccacacgtttaggaaatttagctactagtttcagtatctttcaccaccattcacaactgatcagctaataatcagcaacaacattgtacaccataatatgttaaaggtgttacacacagaatttatgtgtgaaattgaaagcatcggtcctatatcatatggaaaaaaattaattgtagccaaatgttgggtattggatacatcagtgtgctttttcttctaaaaaatactggagaaaggcaggaaatacacaagtactaagataataacacatcaagtcggaaactggttaaaatccaaagaaaaatgttggtgggcgtatttgttcatacacagccccctttatgagaaaaaataatttcttgtacacagctcctttttaaaaaaaagagaaaataatttgtttagattcagacaaaaacacaggagtaattcttgtgtctattctgcataggctgcgtaggttctggctaaaatcactttttaagcagatagaaccattatcagcgtttgaatcaaagggaagtgagtcagatgggatatcttcccttcaagaaagggatctgaaaccatcgttatatttcagaagactgaagaatatcttgccatggcaaagcattccttttcttttttctcggattaaattgagtcatcccacttcttttttcttcacttcagcagtgattaaaggagactatcatattttgctatatcacggtactatttaactttgactatgtctttccttattttaaaaaatgtttcagtgatttatttggaccacaatcagacaagccaggaagaccaaatagctaataatccaaaaaacattatttttctctttttattatttcagtagttttcagggaacccaggtggtgtttggttacatgaataagttcttcggtggtgatttctgacatttgggtgcatccatcacctgagcagtgtacactgtacccaacgtgtagtcttttatccttcacccccctcccacccttccccccaagtccccagagtccatggtatcattctcatgcctttgcatccgcatagcttagctcccacttataagtgagaaagtacaatgtttggttgtctattcctgagttactttacttagagtaatggtctccaactccatccaggttgctgtgaatgccattatttcattcctttcatgactaatattccatggcgtgtgtgtgtgtgtgtgtgtgtgtgtgtgtgtgtatataaacaccacgtacatactgcattttctttatccactcgttggttgatgggcatttaagctagttccgtatttctgcaattatgaattgcgctgctataatcttggtatgcaagtatatttttcacataatgacttcctttcctttgggtagatatccagtagtgggactgctggatcaaatggtagttctacattttagttctttaaggagcctccatagtgttttccatagtggttgtcctagtttacattcccaccagcagtgtaaaagtgttctgttttcaccacatccacactgacatctattatttatgcatgtttgtggaaatcaccttggagtagagtcaagtttaagtgttaaagcattgccatcaactaagtttaaaatcccccaaagactagcaatatgctatttgagcaggcaatgaatctgtgaagtagggataagggctgtgcaggtctctagtgtgcaactggaactcagtattttcttgttgaataagtgaaaaaagtgaaaaggtgtttttgtttttggtgatgaggggcttgtgatgacaggtattattgttagagtcagaaatattttgaggttgcctattaatatggtttggctctgtgttcccacctaaatctcatctcaaattgtaatccccacgtgtcaggggagggacctgatgggaggtgactggatcatgaagaagttttcccccatgctgttctcgtgatagtgagtgagttctcaggagagctgatggtttttaaagtgtgtggcacttcccccttctctctctctctctctctctctctctctctctctctctctctctctctctctctctctctctcctgctgccatgtaagaggtgccttgcttcccctttgccttccaccatgattctaaacttataatcatgaggcctcctgaggcctcctcacgcatctggaactgtgagtcaattaaacctctttcctttataaattacccagtctcaggtagtatctctatagcagtgtgaaaatggattaatacacctattatgttgtagctacatagtgtatgattagacaagccataaatattatatctggcttgtttcatgcccataatagtgtatcagtcagctgttgctgcataacaaataaccacaaaattctcaagttgcatatttctcattcacgcatctgttgtttggctgaacttttgctggcaatcagctggacttgacaccaagttgtggtttgggttcaggtctgttcaacatgtctctcatccttcttgggctagcaagctacctgggccatatgcttcttgtgcacataaacacaagcgggcaaccccaaccagtcaaagacattctaagcctctacttttgtcatgcccgcttacattccattttccaaagcaggttatgtggccaaatccgaatccccaggccagggaagtactgttttcccagctcttgttcactctgctttatctacattagacttcttgctgtgcttgaggaagccagtcacactctcctctcagagtctttgcatttgccaatccttctgtctggagcacttttccctcaaatacttgtgcaactcataccctccagttcttaaagcttttgctcaactgcatctcatcaatgaggacttccaagactccactttctgatgactctcattgtcccttgctagccctctcctcagagtgttcatcaccactcaagatacctatatagtttacttatttacttgttaagcctgtgtgcctccttatgaatgcgagtttcacagagagagtgtgtgggtggggtttgtttgcttattgctatatcttcagtgaacaatatgccaggcactgttcaaccatttgaacagtgcctggcatatatagttggattttaataaatatttgaataaataaatgaatcttactgtttttaaacttttgtggtttttaaaaggcattttaaaaatctgggttagtatcaaatattacaatggtattactttaacttcaggtttcatttagctgttttaacttttacaatatattctgacacagaaaatattaggcattaagcatttttcaatgagttgattcacttctactcatgcacatatgtgatgtctgatttcgattcttaaaaagagatgagcctgggcgtggtggctcacgcctgtaatcccagcactttgggaggccgaggcaggtggatcacgaggtcaggagattgagactattctggctaacacggtgaaaccctgtctctactaaaaaatataaaaaattagccaggcgtggtggcacgcgcctgtagtcccagctactcaggaggctgaggcaggagaatcacttgaacccggaaggcagaggttgcagctagccgagattccaccactgcactccagcctgggtgacagagcaagactccatctcaaaaaaaaagaaaaagagaaaaaaagcaatgcattaaaaccatcttgagaaatcatgaaaatatggagaaaagaagaaaacaagattatactctacttgtttttatactacctagaatgtaataggcactcaaaaaaatgtctgaatggatacaattatcactgccttaaaagttttccattaaagcaaagaagccaattttacatttgtattatacttggacactcatattaaagactcacagagagtttatctggaaaaataaacttggctgacatcattaggtttatactttataatttgatctttgaaataattcaggaacaggaatgccagtcacttcattgaactgtacctgaattttaacacagtacaattgagttcctagagctccaatatgatgtaattaaactgtcagaaatattaacatcgatgttcatgagcgtcgttcatgatgttctcttggttctgatttattcagtgaggcatactgtcactgaagtggacttactgccattaaaaatgcctcatgtttcccagttccgcaaaaatttgcatcagtaatgaaacagagagatgtaatcagccctgcagttgtcaggatcttgatcctcttggtagtatttcattcatttcatcttcaccagataatggtagtttaaaaccgcaagaaaaatgaaactaaaaatagtgaatttcacttctttttctaaaggcataaacttaagcaaatagtgcatgtgtgtgaggggggaggaagagagagagaaagaggagagagagagtttgtaactattccttttctgctttgtgaccttaattcttcagcacccatttcctgtacttaatattgcaaagaggtttcctgtggtatgttaccaggagactcatgtagtctgaggctttttatctaccttacgttcttatccctccattctaataaaaatatgaagcctcacatccacctagaatatgattttgtcttaatggttagcattggcaatgattcttttagcttctgctgttaaaaaaaaaaaaaggaataaatgcaggattctaatcaaacatgaaaatccaagtggcatagaccaaagggaatgagaagcatatttaagtcatttagtcactggcttccgaagcagttccaagtcagatgtaaacctgaggttgtccctaattaagttcattatggttgacttgctaaagcaaggtcttgttttagatggaagtgacaatgtgcaaaacaaacagagcttgaatagaagttattttcactattggaagattgtatattatgaaaagttagtttcaaaggacctttaaagtttaattttgtttgcacctaagaaatttccctttaacttgcaaatgctgtttgaagtgtatttctttaacacatgaacaaacaatacagacacagattcacaaaatctacaaggagatttccattcccagtgaatatcatccatccataggtttctttgcttccagatcatcattctctcctcacataaacagtcaaaatgtttgtaatgtcttctttataaaacccaaaacataattatgataaagtagtcccaagtaacagaggaaaggaccataactctccaatatatgccatatctacagtttttagaatattcatatttcattacctatataggatatatactatttttatttctattacattggagtttaaaggtacttgagtttcgtttgtatttttggttaaatgtcaaaacaaagagtgaaaaaaagacctcagtgtctcaactcccttcttaccttcatgaagtgactgcaaagtgttcaattcttactcttttgtgttgaggagacagcactgcaagtgtgcagtaatacttattttattacatagaacaaagtttcacatttgtgaatggggcacaaaagagagcttgtcagttttacctttttcaattgactttttcttttattctttttaacttttaaatttattttttgtttttttgtttttttgtttttaaatagagacagggtctcactatgttgcccaagctgctctcaaattcctggcagcaaacaatcctcccacctcggcttcccaaagggctgggattacaggcatgagcgaccgcacccagcctgttttttactgtagtataatatttgtacatatttatggagtgcatttgatattttgttgcatacacagaatgtgttaatgatcaagtcagggtatttagagtattcattatctcatgtatttatcatttctatgtgcggggcacatttcaagtaactagtcaacttttaaaaagatacgcagtaggctgggcgtgttggctcacgcctgtaatcccagcactttgggaggctgaggtgggcagatcatgaggtcaggagttcgagaccagcctggccaatatggtgaaaccctgtctctactaaaaatacaaaaattagctggacgtgttggcgcatgcctgtagtcccagctactcgggaggctgaggcagaagaatcgtttgaacctgggaggcggaggttgcagtgagccaagatcgtgccactgcactccagcctgggtgacagagcaagactccatctcaaaaaaaaaaaaaaaaaaagatatacagtttttttttctccaagggtaatgatatagataaactactgtatggatttcttcttccctttaaagaattacttcctcattattaagcttgagggttttctttgttatttatgagcaagtgaaatgaatttataatggtgttaaaaatgtaatcatggccctttaatatctgttttctataaatgtaattttccattatttgtttttgcttttattaaggtgaggaagatcttctcagtcctccccaggacacaagcacagggttagaggaggtgatggagcaactcaacaactccttccctagttcaagaggtaagctccaatacctagaagggactcagatttgctgggatcaggccactcgcttccctacccaactggtgtgtgtattttccatatggaagccaacacgcagtatcagaatggcaatttgggtccatggtgaaaagatttgatttttaagtgtgaatttgtggtttagagtactctgaattcaaatacccgtgagggcaacatgtttccaaaaataagaataccaccctctatttgtcaagtattttacttgcttcacacattagtctgaagagttaattatgaggtgccctttactgaagagcaattattatgtgacttttacagatgaggaaattaatgccctgatagtgcctttgccagggacatatggctactacgtgctacagcaaggcctagaacaatgcctactgattggtagtggtagagattctgacttgccatctgatgccctttatatttaaaaattgtatcttactccatcatttaaatatagggacaattaaatcttcatagagtagttggttattttttacttcgatagaggaaatacaggcttagcaaagaaagacattaatatttttctttttcttcatcactttggccttgcgtattttacccccatacaaaaacagcattttaccctgcagaattttcccactggcttgcatgagcttcagatgtcttgcttcatccaagatgatgttttgctgctactgttcgtttctgggggcatttatttggtttattgccctcacataaaacaaagtcactctctcgccttccttcaacgaataaaaaggatggtggcagtcacctgtgatcaaatagaagaaaagcctagagaaacaaaagggagaaaacacaaggctttgtggccagtgattggcacctctaatgggtagcctgggagggacgggcagcaggaaatctgggctgtttgttcctctccataagggcaatgaggagggtgtattgagtagtgtgtttttcctatctttttgttcagtgtcagttaacaatggccatttcctagctatttgatgtgcaagtaaacgttgtgcagtgcacattaaaagcaataatgttctggtagagcgttgctaaggaaccgtcaggggaagctaattttaaatgtctgcaccagccatcttttcactgctgagcgccactgaagtgatgattttaacagataaaaatcttatctgtcttccacccacctccacatcccccaccgccacccgcatccccattctgactatcttaggtatctccttcttctagatgtcataattcataatgagaagatcatacacaggcttgacagaatcaggtgctttcacgtgtctcctcattactttgtcctgcttgcttttactagcacctactacgtaccagtggaggtagtagggatggaaagaagaaatgacaaattccttgccttcaaggtacttatggtcaattgcagatacagaactccaaagaaattcaaatcacagtacaatcattgattactgtatgatcctggccccttgaactggcagcttgcttacctgctctggaaagttgctggctgccctgttggcaccctgggcatttcttccacatctaaacaagaggttagtagagaagaagctacagcaaggctcatgactctgcttcttcataggcagccttgacttcctagactcctttttgtacctgagtttctggtccaccctaattagctgtaaggtgaaatcctttgcaccatctccctgtgtcccgcttttagagtccttaaagctagataccacatgggtgtagaagcttcctggaagacaagaaatatacctcctctgatatggtatttagcagtcagtatctctgatgttgatttacttacttgtatggaaacttgggaaactcaattcaggccacctggatagtgtttactaaattagtgcttacggaagaatttcaggccttaagggctgatttaagttctcaaatgtgggagaaggaagccttgtccgataccaattccattaacttaagttccggcttactcagtggtacccttgtggcctgagaaaataaattcacattcttaaaaaacaaaacaattaaatacacaaaaaacacaagagagtagctaaggtattggaaaatctggcctatcattctgtaataccatgatcttggcatttcctcacgttttgctactttcagctaactcaggctttcttacaggcctttttctccccaaattcaagtggataaaaagtttcattattgtaaaaattaggctaattattgatgcactcaaaaaagtggtttttggatgctttctttccaactaaaagcacttttgttttttaattttgaaaaatggcatatgtgtgtgtacacacacatataccgtcaagtttggcgggaacatcttaccagttggtagatgtgttcagctgatattaagcagaaattcttgagaatcttaacatcttgggattacaaagtctttcaaatggaagagccttgaaaggtcattttaacacttttgacatccaggacagtgatttctgactctgttttgatggttatccatatcagaggaacattttacatcacaaactggggtaaagatataaaataaattgtacatgtgtttatgtacacacatgtatatatacacccaccatatgtacacacacacatttacagtgtcatatgcatacaaagatcagaaacaaaagtttcatcaagtgatgccttccatactacatacagtgcatgctgtttttctattttatttatttaaaaacaaaatgctggttgcaacccactaaatggattttctgaaccagtggtttaaaaatactaatctatgtgatctcagtttttcttgcctggttgaattatctttcaaaaaaatttaaattttgagatttttgccgtggaagtttctgccaagacgttgctaatgtctcagagacctttatagttttattctaacactaccatccatgttctcattgttgtgttacaaaaaacaaagttcatgattgctacagctgttttggacagctgtttgagtaactcaaaacagatgtgagagccagaggtctgacatttagtggaaatgtgctattaaataccaccgcgtggtttacttaaccctgctagataattgcccacagaggaaaagccgtttttaaaaaacttatgctcttcataaacataaagtatatagataggtaagctattatgtacctcaaatttacaacttttctgttgccccttgccacagagttggtcctgaaggtgtcagctaacctttctttatcttttattttcacaaagagtacctggaagccaagaaaagtcaagtgccttatttatggccattcagcaggttaagttaggcttctaatcttatcttaatggctttgctaaactgttatcaaaattaataaatgagtggcatgcttctccatttagtgataaaccgatggccaacactatcctgcataataggcaatataagcaggagcatattcaagatatgaatgtgtaaacattcagctttgtgattatatctttctggttggtctctagatatacttagttgttcacaaacacttgggagatttgagtggctcagtgtatatttgaacactgaatattagccaatttctatctaatctgtctatctctaatctcttcctttgtaagtatatgtgtagaaattgaattatagtgtaataagtcattatctactttactataaggtactctctaaagctctgccattctataggaaaactacatgggtacaataaacaaacgtaatttaaaaaataaccccattaagtgatttgtccataagtctctgatcatttagcagactaacaaagatatttttatatgtatgtgcattgatgaaagaaacgctctcctagtcagtagtatggtattaggctctctaaaatgtggtaccactttatatagatgaatgaataataggagccaagataagctcttaatgcagtaaaacaatccagaaagcagttagcagtgctactatttctgctacctgtacaatctcttgcctactgacctgtgccacattatctccaccagcccatgccatcctctttttttcataccatcccctctcaaataagcccgcgtacattctatcaaatacccctaaattaccaacccaacagctttgtaaaacctaccgtcttttaaaattaaaatcttattctgtggttcttttatggaagagcaacataaagaacaaaggcagatagaaatatggtgtgccctttttcaggcaccattctgtttcctgtatgctcccacaaaggatttgagcggttatccctttaatccaggactagcaaactacatacagcccaaatgccaaatctggcccaatacctgtttttataaagctttattggaacacagccatacccattcatttacatgttgcctatagttgctttctcattaccagggcagagtagttgcagcagtgctgaatagctggtccagagaccgtgggcttgcaaagcctgaaatatttactatctggccctttatggggaaaatttgccaatccctgctttacgctattatttcgttgtccattctgactcattacatgtatagagtcacaggcttctgtgctgatcaactttcagctgaacaagattattgagctgaaattgaattgatttatagatttatattcatattcaccaaagagcctgcaagtgtggccatttgaatttttttgacttataaaataacagaaatcctaaaaagggacttattcttccttaagtattttaaatagtcagtgaattaatataaaagaggctaaaagcacccagaaacagtactgtcctgcaattccaactctaaaataatgaattacaatcaataatgtcaattttatagtgcccgaggaaattagacttctcgggacctgaccaagccctttatttagactcaggactgccccagcacacttcccttttgtcttgattcatttcctgacaacacatcacattgccagatggacactgtaactgaaggtctacagaaactcatttccaaaaaaaaataaatgtttagaaaatgaaacatatctgaaactttatttatcggtcaagaacttttaaaaatgttgtaatcaagtagcctctgttttgtcagcgtagaactagtccttttacagtagaaaatatcatttgtttttaactttttctaaagtgaaaaaaaggaccttccttttgtaatgtgttaatgagtacgtggggacccaagtgatgagggaggattttagaagagattagagttagcttggctctgggaggtccattttcataaaatatggtttctgaagaaggatctggaacataacacaagtcatttgctgctacatattaagaaataatcaattgataactgagttctgaatatggcttagtgtagaattactaaagatatgtatcattaagcattcaaagaatcatcgttacattctgaagtacataaccataattacattctaaatcacatggctttctaacaacactgtccttcctaaagatctcaagttttcaaaactagaccaaagttacatgccgaaacaagttacccacctttggcatccaaactaaagtgtgccagtgaagggcaagttacttataacacagaaggactcctcttggtcatgacccaactactactttaccaattcacttcagccagtatttatcaaataccaaaagtgtgtatatacggtacagggcattgggcatagagaggtggatgagcaacatgtggaccccgtcctcaagaggcttatagtcttacaggggaagggaattaattctgccaccagacagtattatgaaacataaagatacttttttaaaaaaaccttgctaaaggaatcaaaaagaaggggtgagtgattcatactgggatttcagccatcaaggaaagaatgatgttctcctccccaaatgatgggaacatcatttggtatggatctcccactagtgacacccacagctgaggagctagtacccatttttctccctcttttccctggcttgaggagcatcttaaatacctggcccttacgtggtcaagctgaaaatctgatactcctaagaaatcgctgagtcatgtaggaaattcagaaggaagagaggaagggagagaaggagaaagggagggaagaaagagaaggagagagggaagaaaaacttagaaactatccttaaatgtatactagaagttttgaaccctaaccttgagtgagttttgaaaggtttctattggtgtcgtagctccatacctcttcattccagactagtagttctcaaattgtttcagggagtttttagtcttcttggagccactgagaatgatgggtggaggggaaagggagatgctgtacaggatctctcacagctctgctttgaactgctcaaaatattggaattccatataagattgttttaggagatgtcccattgctatagttaaaacagtttgaaaaccaagattttaaaggaaattgcatgcccaagacaggctattgacatgtatggacagaagtccctacttttctgtccaattatgacttatcatagaacactttctcatcagagtctacttttgaaatacaaataaatgcatacagatgtaggaatctatgaatcaaggccagtgggtctttagccattgcctcgtaaggctcctgatatttgctgaattggggaggaagtggaaagctcattcctggatctggctctgtggcttgcccattactgggacttacctcttcccctcatctgttctttctgttttctcaaatgcctccaatttcatcatggaaatgctcagcttctatcagatagaacaaattctcccaagaggatggagtccagcctctatgtcgggttctaccttgcatttgatgtgcagactttgggcacacagagtcaactactgtttatgtttcaatgtgctgattgtcaagagtgaagagattctgagactttttttaacattaagtttgagttgtccttgaaaacaatgcccaatttgtcagatttctattctgtgccagttttcatccagtttaatgcgtgaactctatggattttacaaatgacgtcttctggatcatgttatctgtttacactgatcttaagtgtatgtaaaggttatttgactagatgtgtcttttgggttttttgtttctgtttttttttttttttttttttccagcagagaataaatggtcatctcaacatttgtttggtaaaagaagcaaattggtatgaaattgtatatttatgcatgttttttttccctttctgatatctctgcctcttcctctctctattattaaaggaagaaatacccctggaaagccaatgagagaggttagtgagattcaggctcacggccatggcttctgtctgtctcatcctgctttttatgtttggcgtttgtgtaagaattgtgtgtgtgcacgcgcatgtgtgtattacacattgtgtcatcatgtaaggatggtagtcacctctccacttgcagctcatgaggaacattcctcaaatgttcattgccgttgtcatcaccatgacgacaagactggggttgggagcaagaatctctttaaaatggcaatcctttgtagtccctaggttggaatcctgccgttcatcatctgttgccatttgcaacactaacaaaatcttcaaaataaatttagccttgaacataactgatgagtcataaagctttcttccacttccaggaccttagcattttctgccagcgcccttagtttttattcttctgggatgacttcattttgcttttgtttccttttttcttggttcctacgctctttctctcccattttagcgaacattttttgagcacttactgtgtgccaagcattgttctcagcacttgccatctttttcatcatgtcatcttcatgacaaacctgtgaggtaggtactcttattaaccccgttttacagataaggagactgagtcaatgagagagtaagcagtgtgtcccaggtgacagagccaaggatttggatccaggcagtctggctccagacccacactcttaactctcatttgaaaggcttacatcatctcaacgtacccttcagaagatgatcttttttatttggtatttgaagccacacagaacaataaccaattcgattaaaaaattaaatattggagttttgagaggtttttaaaatgcctatttatgggttgaaagggatagggtgcagtcttatcactgaatgtggtttcaggttttacggtgaaagatgcttcttactcctattccaccaggaatattgtctgaatatcgaattacctaattaagtgactgttggatgacaaagtgttaactgacagcccaagtaaaatcaaggttgtctttaccaagaatttaatctgaaggaggagagaaggaaagctctcccatgggatgacagtgttctgggagacaggctggatgggtggagagtccttcttaaatgagaagattctggattccttagcaacaggatggactggagagaccactgattcatttaaacacaggagtcgtaatgaaaactctgccaacatcatgccatacaagtctaatcaatttaatgattcttcagtgtgtctgtgccagtgcctccttccaaggctttgggcagtggggccagggagggaatggtaggctgggaggagaaattgaggaaacctgacttggtgaagcattgaatgcccctgacggtttgcctggttcatgtacttcgtatgtgagacttcttgggttcattcttatggtaagtgccccttaaaatttattcattttaactttttgtagaaaaatgcaccataattttgaccaccttaaacatgtttcactcacaaatgaatttcagaaaaggctagcacatgtaattgaagttatataggcatttgcagacttgactacctgaggtgtatggtgttcagacaagtttccagaagccaaagaatcaaaacaataatgaccttttttaatgctatgaaaatatcccaaatgtacgtaaagcagatttttttcagagattaaattatagagaagaaaagataagcaaatttccctgtagtattccggctttcctttggacaactgaatgctaacaatttatttgggaattgtatttttaaaaaatagagcaccagattgctattgaggtcttggatctttgccagaaagtctcaattccaatcgctgtggaaaacaattccctcaggcagtggtgacgtgtgagactaaatgtgttgcagttagcgccaacttgaaaaacatacaactgccctaatgttcaaggcatagtgcctttgtgttcaataatccttaagaatggattaaatcaatactttctatagacatagttttctgtcaccttgtgcctgaaggtgattgcaaatgcctgaatcctggctgcttttcagtacctctcatacttcatagtatgagattgtaattttgactttagaaaaatctgtcaggtaacattaatgacctcccgaatgctctgccttacacacatggataatagaactaggatacaaatctactttctatagtcatgtcacagtgcagtcttacccctccaacggattaaagtatgattctttagggcagtagtttgtaaaaagagattgacttcttttttctggatctaatgaaaaactccatggaaagaaattagaattatttattctggtaaagcaggtatttagtgaagtaaccaaaggcataatatagatgatgaggtgactctaaaagttctttatttttatagcacaaagatggccacaaggtcatttgtgaaaatgcagcagtgtaaaccggttaaaggccacccaactttttgtcggagtgtgcatggcacattaagaataatgaacctgttttccctggcaaatctttaaatagcagatacccctagaacttatgcttcttgagagactcaagaattttccttccagttagtaactgaacaccatttcaaggaagagaagcaccacttggctatataatccataaatgcatttatttgttttattatattttgaactgccatctacatcccctagcacacagcctaaaaagaaagacactttgtgattatcgataagctgacaggaaaaaaaatgagttttctccccttttcgttgatgttttgtaatatgttttctagctactaggtggactacatactatagtcacatgtgggccatgagaaatacttcgaattacattcaggcaccatgttgtaaaggtcctggactttgtttttactgattttgttaaccgtaaagatcgctagtaattaaaaattggcagttagtccatctatcttcaatttatgcatgaataattatgcagatttcccagggttgctggacagccaaaaatagatacaggggaagccctccaacttgatagcagcagttatatatttgtactctgagctctaaggagcagcaaaggccccactgtgtcgtcttcctgtggtttttatggcacagaaagccaaaaatgatttcagttcttcactgagggctgccaaactattggcccactttatgaatagttgcatatgctttgttaaaaaatttttatacttgcagtctcagccaaaatccaaagtgattttctaaaatataattaatactccatgaaattctttgcactaataaagcacaaaaagatagatatacaaacttggtcaccttaatagaaatgcctgaatgacattaaacttttaataagtaagtcttcagttgatctggtgccatcactgtttaagtgcctgcccgtgaatccgcttcattttgtagagaagctatatctcttgaaataaatattaaaacaaaatactctccctagtctatagctttaatttttattgggatatctttaatttttattggtatttttaacaattattatgggaatctgtaaagttgatacatggcaaggtagtaatagcctagtaaagcatttcagttccaaagacaatacttgaatagtggaaggatttaccaatgtgcaataattaaaattagccatgtaaaactatgggacatagacgaaaaggcaagccataaagtaagtctcagattatcttactctaaatctgaattttgctacgaagtacccagggacattgtgctgttctttttctccgtgctgggagattcgtgctaggtcgtgctgcattattagtaaaaggctattgtgatagttaaccctcatttaggaggagctctaagatggattcacaaaatacccaaatgcatacaatacatgtgggtcaccttataattagggtctagagtaatttggaatgtaaagcaatttttattctgaggtttcctaattcaaatgttaatagtgcaccaaaaggtcaattcaagagtttattattattatttttcaacccaagtaaaagcagagagaaaatagccacctccaccatagcctcagaagcaagccaacagcctgaaacagctttgaaatgaaaagttggtgtggcggtgatggtggcagtgataatggtgacgatggttgggtgctggtgatggtagtggtagttgtgaaggtggtgatggtggtttgattgatagtaaaaaaaatgttcgttaatacaagtagagagtaagtaatcaatcaatcactcatagccaaggtggaaaagatgtatcccatcatggaatattcctgttctgatagaaatcttgtgcttatctatggaattcttttgatatatatttacattgggaacctgaatgtagcttgacatttttccatgtaaacaccagtagcctgatccaacattaagctgatactaacaaacaacgtgtaatggcttcattaataaggctttgcttcttcctggaaactggtgaaaaatcaaaccttgttgtgtacaccctcgatgcagcttctgtgttgtcttcacccagaaatggggaatgatttcccaaatggcaaagaaacagagtgatgctatctatctgcaccttttgtaaagtctgtctttctttctctttgttttccaggacacaatgtaggaagtcttttccacatggcagatgatttgggcagagcgatggagtccttagtatcagtcatgacagatgaagaaggagcagaataaatgttttacaactcctgattcccgcatggtttttataatattcatacaacaaagaggattagacagtaagagtttacaagaaataaatctatatttttgtgaagggtagtggtattatactgtagatttcagtagtttctaagtctgttattgttttgttaacaatggcaggttttacacgtctatgcaattgtacaaaaaagttataagaaaactacatgtaaaatcttgatagctaaataacttgccatttctttatatggaacgcattttgggttgtttaaaaatttataacagttataaagaaagattgtaaactaaagtgtgctttataaaaaaaagttgtttataaaaacccctaaaaacaaaacaaacacacacacacacacatacacacacacacacaaaactttgaggcagcgcattgttttgcatccttttggcgtgatatccatatgaaattcatggctttttctttttttgcatattaaagataagacttcctctaccaccacaccaaatgactactacacactgctcatttgagaactgtcagctgagtggggcaggcttgagttttcatttcatatatctatatgtctataagtatataaatactatagttatatagataaagagatacgaatttctatagactgactttttccattttttaaatgttcatgtcacatcctaatagaaagaaattacttctagtcagtcatccaggcttacctgcttggtctagaatggatttttcccggagccggaagccaggaggaaactacaccacactaaaacattgtctacagctccagatgtttctcattttaaacaactttccactgacaacgaaagtaaagtaaagtattggatttttttaaagggaacatgtgaatgaatacacaggacttattatatcagagtgagtaatcggttggttggttgattgattgattgattgatacattcagcttcctgctgctagcaatgccacgatttagatttaatgatgcttcagtggaaatcaatcagaaggtattctgaccttgtgaacatcagaaggtattttttaactcccaagcagtagcaggacgatgatagggctggagggctatggattcccagcccatccctgtgaaggagtaggccactctttaagtgaaggattggatgattgttcataatacataaagttctctgtaattacaactaaattattatgccctcttctcacagtcaaaaggaactgggtggtttggtttttgttgcttttttagatttattgtcccatgtgggatgagtttttaaatgccacaagacataatttaaaataaataaactttgggaaaaggtgtaaaacagtagccccatcacatttgtgatactgacaggtatcaacccagaagcccatgaactgtgtttccatcctttgcatttctctgcgagtagttccacacaggtttgtaagtaagtaagaaagaaggcaaattgattcaaatgttacaaaaaaacccttcttggtggattagacaggttaaatatataaacaaacaaacaaaaattgctcaaaaaagaggagaaaagctcaagaggaaaagctaaggactggtaggaaaaagctttactctttcatgccattttatttctttttgatttttaaatcattcattcaatagataccaccgtgtgacctataattttgcaaatctgttacctctgacatcaagtgtaattagcttttggagagtgggctgacatcaagtgtaattagcttttggagagtgggttttgtccattattaataattaattaattaacatcaaacacggcttctcatgctatttctacctcactttggttttggggtgttcctgataattgtgcacacctgagttcacagcttcaccacttgtccattgcgttattttctttttcctttataattctttctttttccttcataattttcaaaagaaaacccaaagctctaaggtaacaaattaccaaattacatgaagatttggtttttgtcttgcatttttttcctttatgtgacgctggaccttttctttacccaaggatttttaaaactcagatttaaaacaaggggttactttacatcctactaagaagtttaagtaagtaagtttcattctaaaatcagaggtaaatagagtgcataaataattttgttttaatctttttgtttttcttttagacacattagctctggagtgagtctgtcataatatttgaacaaaaattgagagctttattgctgcattttaagcataattaatttggacattatttcgtgttgtgttctttataaccaccaagtattaaactgtaaatcataatgtaactgaagcataaacatcacatggcatgttttgtcattgttttcaggtactgagttcttacttgagtatcataatatattgtgttttaacaccaacactgtaacatttacgaattatttttttaaacttcagttttactgcattttcacaacatatcagacttcaccaaatatatgccttactattgtattatagtactgctttactgtgtatctcaataaagcacgcagttatgttacaaaaaagtattgactggactgcagtactttgtttttattttaatttagttgttgttacttacttacttactttttaaataggtaatacatgcatatgagtaaaaaactataatccagaaagacagtgaaaacactcctaactaccccttcccccatatcaatcaatcatcctcattgctctatgagtagacattattaatttcttatttagtcttccagagggtctttctttattaattattatataagcagttaaaataatatatatgttcctatttatttttttcctattattatttcataggatatagcattctctgcacccagttatgcaccttacttgtttgtttgtttaaatttaaatatggactcaagaaatcttttcatttaaatatataaaatgctttctcattcttttttatagctgtataatatttcattatatgttcataggatattttatttaagcagttccctttggtgggatatgtagtctgttgtcagtctttcttttgctataacaaacaatattgcacatttctcattacatcatttcatttgtgcataaacaaacaaatctgtgggatacttcctagaagtgagattgctggatcaaagggggtaagcatttgtagactgggagatgatacattttgtgcagtgattgattgattgatagtcatagtgtttgtttgtttgttgtgttttttgttttaataatgacaagtatattaattaagtcagtttgcagttcatactttgcttctcaagagaatttcatatcacttctattcttaatgtcaccatctaagaggatgcatgagtgagtagtaagaaagagacacctaaaatgatgtctcacaactggttctggggaagaagaatcccttaccatagtcaaccaccaccatggggagaacctctcctttgcccctgccctgctctgtttcttgccctagctgcaaaggaagctgagaaagtgggtagcaatgtcagcacttcttagggagaggctatctatctttacctattcccaaggttcatggatggggtgggcggggttccccaacagtgttcagatactggtgagccaaaggaataacataagtccaccaggtgcagcctatcctagtgattttggaaataataggagatgagatgatccatctcattagaaatgatgtttgttagtagatgtggcatctctgctgtgaatcaatcacttgctaattttttgaaagtagggtgatgatgctgacctaagtgactaccacattgaaacacttcccttgacatccacacataccaagaaaaattttcatcctatttaaataaacaaatcatttatccttcccaccattacccgaacctacctttgtttgaaacacccagactggctgttttggtgacacttaaggaggtaactgaggaatcttcaatacttcaccacgtctaagacaactgtgtgtggatgactctgaggagggcatttggttttccattccatacttggcacacactagaagagacagaattaattcagttaaaaattaaaatgaatcgagctggcacagattatgcaccggcaagcaaaatgtgtgtttgtttgggagaaagcaccaagactaatggatgtgttctgtagagctgcgatgggatttccctgaatttgtaatgctctaatggtggaatgaatacaaaggcaggcactggcgcacttgcaaagactttgccttcaaattaagtgtaggaaggacacaaatcaaattctttcccacagtagcaaagccattggagtaggaactataaatatgttcttcaatgccccttgcacgtcagtgtactgtgatctcatggacttagctgacaacacaagagtggcagcatgcccaacattccataataaacaatattgtgtgaatgtgtaaagtttggggatgtttgtttgagagtagcttttgtgtacagaaaaggttacctacagtaacttgaggtttaaatgttatatgtacatatgtgtgtatgtacatgtgtgtattttatatacattcaggattttagctcttccataactttattttgaaataattcaaacaagaaaaactgaaacaaaagaaaaattgcaagaacagtacaaagaaagaacccacatataccctttacccaggttaatgaattgtttacattttgcttcatttactttatcgttctctcaatgaatagatgatagtttttcctgaaccattttaagaataagttgtagacatcatgcctccttacatttaaatacatcatgtacatttcctaatatctaggacagtctcttgtataaccatagtacaattatcaaaataaaaaaattatatatagctatcatctactccacagtccatattcaaccaaatattgtcaattgtgccaatgatgtctttcatcattatatatatttccctagtctggactctaattcatgatttcatgacatttagttgtcatatctctttaatcacctttgatccggaacagtgtctctgcctttctctgtcttcaaagaccttcacatttttaagagtacaagacagttactttgtaggatgtgcatcaatttgggtttgtctgatgtgttctcatggtttagattcagggtatgcatttttgtcaggaatactacacaaacaatgatgtgtcctcagcatgtgataccaggaggcatattcccattcttggtgctgttaacactgatcatttggtaaaggtggtgtctgccaggtttctccacttggtatacattttaaaacctaagttttcataaatctttaggttcaacttagaaatttcatttttagatatataaatgtagacaatttgtatgaagtaagaacagtcacttttagtgagcagacttagccacgttgagtagtctgaattttttcgttctaagctgtatttatacacttaatgtgctttattttcaagcctatctaatatctcacagggaagaccaacgccaaccaacagcacctccaccatacctaactcacatatatcgagacaaacatataaatatagtgaatctcaagtcctctgaaacattccaatagcatatactgtatgagctgagtccaactttttttattcattttgaaataataacatgtgtaaaattacacattttacattggaacctaagacatctctccaatttgctaatatgtcaaattgccacaaacatcttaagcactttaaacgaacacagattatgcctaaattcaacataaaagtattaaaaccaagggttaggtttactccaccatctctttgtttcattttaaaacttcctaggctttcaagacttatttgataaggtgtatattaaaatgtgacccaggtgtgttaaagtctttgaatctcatagttttgagggtggccacatgaggtctgtagccttcagcctcctgcagttaatcaaggatgcccttcaattgataataaatgtatctgtgtgccacaacgtgaaaacatttgggaaactctgcacgaagagaatacttttatcatcacaacaagagttgaggttactggctcaacaattcctatccatactaaaattaagcatcctgggcatgttgacaatttttatcagccaaaaatttgtgactggactgagtaactcttttgatgccacagaaggataagcactcaattcctttttaaagtcagtacgacaattgggggactccaagcctgtactttccagatacgattgatttcacaccctgtgttcctgggttcaatttccccctttatacctgtgtgggtagctgcaagctcctatactaggactcccctaagtcctagtgtgcctgcttcattgatggctacatctttcatcatgacatcattatcaatagcaccctttcaatctcaaaaatgcccttcttagtaggtacacctaatgtctttcaaacacactgtttctcaatagaaatgttgttggtatttgggttgggacaattcttcattatgcacaactgtccctcactttgtagttctcccagtcattttgatgacaaacctgcctcaatacattcccaaatgcctcctagggaagcagtagaaaattgctgattctctttactgcctgaatacaggctgtgttcttttcatactctccctaactggcaagctccagctcttagagatattttaatggcattagttcttgcatacttttcctattttgtccagccctccagtcacttctctaaagtaatttaatgatactacgctagctgaaaacattgaccatgagataaaagccagcaaataaaagtatttttcgacagtagagaaagaagctatccccattcatttgcattcatttaaatgtaacatctggactcttggtgcgttttgagcttgtagatacaccccagccacatcccctcttgtcttcagagacagtgcatccatgccctcgcttctgggaatatcagctgctgatggctcacaactgtgtccctctccggacacccc
